US010023862B2

(12) United States Patent
Bettencourt et al.

(10) Patent No.: US 10,023,862 B2
(45) Date of Patent: Jul. 17, 2018

(54) ORGANIC COMPOSITIONS TO TREAT BETA-CATENIN-RELATED DISEASES

(71) Applicants: Dieter Huesken, Basel (CH); Brian Bettencourt, Cambridge, MA (US); David Bumcrot, Cambridge, MA (US); Satyanarayana Kuchimanchi, Cambridge, MA (US); Stuart Milstein, Cambridge, MA (US); Michael Schlabach, Jr., Cambridge, MA (US); Frank P. Stegmeier, Cambridge, MA (US); Markus Warmuth, Cambridge, MA (US); Jan Weiler, Cambridge, MA (US); NOVARTIS AG, Basel (CH)

(72) Inventors: Brian Richard Bettencourt, Cambridge, MA (US); David Anton Bumcrot, Cambridge, MA (US); Dieter Huesken, Freiburg i. Br. (DE); Satyanarayana Kuchimanchi, Cambridge, MA (US); Stuart Milstein, Cambridge, MA (US); Michael Ray Schlabach, Jr., Cambridge, MA (US); Frank Peter Stegmeier, Acton, MA (US); Markus Warmuth, Natick, MA (US); Jan Weiler, Cambridge, MA (US)

(73) Assignee: Arrowhead Pharmaceuticals, Inc., Pasadena, CA (US)

( * ) Notice: Subject to any disclaimer, the term of this patent is extended or adjusted under 35 U.S.C. 154(b) by 0 days.

(21) Appl. No.: 14/371,131

(22) PCT Filed: Jan. 8, 2013

(86) PCT No.: PCT/IB2013/050159
§ 371 (c)(1),
(2) Date: Jul. 8, 2014

(87) PCT Pub. No.: WO2013/105022
PCT Pub. Date: Jul. 18, 2013

(65) Prior Publication Data
US 2015/0291954 A1 Oct. 15, 2015

Related U.S. Application Data

(60) Provisional application No. 61/584,530, filed on Jan. 9, 2012, provisional application No. 61/598,530, filed on Feb. 14, 2012.

(51) Int. Cl.
A61P 35/00 (2006.01)
A61P 17/02 (2006.01)
C12N 15/113 (2010.01)
A61K 31/713 (2006.01)

(52) U.S. Cl.
CPC .......... C12N 15/113 (2013.01); A61K 31/713 (2013.01); C12N 2310/14 (2013.01); C12N 2310/321 (2013.01); C12N 2310/344 (2013.01)

(58) Field of Classification Search
USPC ........... 435/6.1, 91.1, 91.31, 455, 458, 6.11; 514/44; 536/23.1, 24.5
See application file for complete search history.

(56) References Cited

U.S. PATENT DOCUMENTS

| 2,779,780 | A | 1/1957 | Middleton |
| 4,169,846 | A | 10/1979 | Inagaki et al. |
| 4,261,989 | A | 4/1981 | Sasaki et al. |
| 4,439,196 | A | 3/1984 | Higuchi |
| 4,447,224 | A | 5/1984 | DeCant, Jr. et al. |
| 4,447,233 | A | 5/1984 | Mayfield |
| 4,475,196 | A | 10/1984 | La Zor |
| 4,486,194 | A | 12/1984 | Ferrara |
| 4,487,603 | A | 12/1984 | Harris |
| 4,522,811 | A | 6/1985 | Eppstein et al. |
| 4,596,556 | A | 6/1986 | Morrow et al. |
| 4,790,824 | A | 12/1988 | Morrow et al. |
| 4,941,880 | A | 7/1990 | Burns |
| 5,030,453 | A | 7/1991 | Lenk et al. |
| 5,032,401 | A | 7/1991 | Jamas et al. |

(Continued)

FOREIGN PATENT DOCUMENTS

| CA | 2359180 A1 | 8/2000 |
| CA | 2677068 | 3/2011 |

(Continued)

OTHER PUBLICATIONS

Alignment Data re: SEQ ID No. 6121.*
Sequence alignments.*
Original sequences from U.S. Appl. No. 13/937,412 and U.S. Appl. No. 14/371,131.*
Agrawal et al, Molecular Med. Today, vol. 6, pp. 72-81. A. Branch, Trends in (Year: 2000).*
Chirila et al, Biomaterials, vol. 23, pp. 321-342. (Year: 2002).*
Peracchi et al, Rev. Med. Virol., 14, pp. 47-64. (Year: 2004).*
A. Branch, Trends in Biochem. Sci., 23, 45-50. (Year: 1998).*
S. Crooke, Antisense Res. & Application, Chapter 1, pp. 1-50, (1998, ed. by S. Crooke, Springer-Verlag). (Year: 1998).*
Behrens et al. 1993 J. Cell Biol. 120: 757-766.
Behrens et al. 1996 Nature 382: 638-642.
Bernstein et al. 2001 Nature 409:363-366.

(Continued)

Primary Examiner — Jane Zara
(74) Attorney, Agent, or Firm — Robert Michael Teigen

(57) ABSTRACT

The present disclosure relates to RNAi agents useful in methods of treating Beta-Catenin-related diseases such as adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing, and similar and related diseases, using a therapeutically effective amount of a RNAi agent to Beta-Catenin.

9 Claims, 1 Drawing Sheet

(56) References Cited

U.S. PATENT DOCUMENTS

| | | | |
|---|---|---|---|
| 5,064,413 A | 11/1991 | McKinnon et al. | |
| 5,266,573 A | 11/1993 | Elf | |
| 5,312,335 A | 5/1994 | McKinnon et al. | |
| 5,374,548 A | 12/1994 | Caras | |
| 5,383,851 A | 1/1995 | McKinnon, Jr. et al. | |
| 5,399,163 A | 3/1995 | Peterson et al. | |
| 5,399,331 A | 3/1995 | Loughrey et al. | |
| 5,416,016 A | 5/1995 | Low et al. | |
| 5,607,677 A | 3/1997 | Jamas et al. | |
| 5,621,002 A | 4/1997 | Bosslet et al. | |
| 5,962,016 A | 10/1999 | Willis | |
| 6,506,559 B1 | 1/2003 | Fire et al. | |
| 6,680,068 B2 | 1/2004 | Campbell et al. | |
| 6,780,996 B2 | 8/2004 | Boschelli et al. | |
| 8,084,600 B2 | 12/2011 | Natt et al. | |
| 8,097,716 B2 | 1/2012 | Weiler et al. | |
| 8,518,907 B2 * | 8/2013 | Brown | C12N 15/113 514/44 A |
| 8,815,825 B2 * | 8/2014 | Brown et al. | 514/44 A |
| 8,835,623 B2 * | 9/2014 | Brown | C12N 15/113 536/24.5 |
| 2002/0137210 A1 | 9/2002 | Churikov | |
| 2003/0012812 A1 | 1/2003 | Tormo et al. | |
| 2003/0177507 A1 | 9/2003 | Hoener et al. | |
| 2003/0182672 A1 | 9/2003 | Graham et al. | |
| 2004/0038921 A1 | 2/2004 | Kreutzer et al. | |
| 2004/0064842 A1 | 4/2004 | Graham et al. | |
| 2004/0204377 A1 | 10/2004 | Rana | |
| 2004/0208921 A1 | 10/2004 | Ho et al. | |
| 2005/0255487 A1 | 11/2005 | Khvorova et al. | |
| 2005/0281781 A1 | 12/2005 | Ostroff | |
| 2006/0193870 A1 | 8/2006 | King et al. | |
| 2006/0240093 A1 | 10/2006 | MacLachlan et al. | |
| 2007/0039072 A1 | 2/2007 | Khvorova et al. | |
| 2007/0042381 A1 | 2/2007 | Bentwich et al. | |
| 2007/0111230 A1 | 5/2007 | Pompejus et al. | |
| 2007/0135372 A1 | 6/2007 | MacLachlan et al. | |
| 2007/0207974 A1 | 9/2007 | Khvorova et al. | |
| 2007/0275914 A1 | 11/2007 | Manoharan et al. | |
| 2008/0113351 A1 | 5/2008 | Naito et al. | |
| 2010/0105134 A1 | 4/2010 | Quay et al. | |
| 2011/0152353 A1 | 6/2011 | Koizumi et al. | |

FOREIGN PATENT DOCUMENTS

| | | |
|---|---|---|
| WO | 2000035436 A2 | 6/2000 |
| WO | 2000044914 A1 | 8/2000 |
| WO | 2000063364 A2 | 10/2000 |
| WO | 2001002369 A2 | 1/2001 |
| WO | 2001004313 A1 | 1/2001 |
| WO | 2001075164 A2 | 10/2001 |
| WO | 2001092513 A1 | 12/2001 |
| WO | 2002006213 A2 | 1/2002 |
| WO | 2002010192 A2 | 2/2002 |
| WO | 2002044321 A2 | 6/2002 |
| WO | 2002066470 A1 | 8/2002 |
| WO | 2002100435 A1 | 12/2002 |
| WO | 2003015757 A1 | 2/2003 |
| WO | 2003064383 A2 | 8/2003 |
| WO | 2003064625 A2 | 8/2003 |
| WO | 2003064626 A2 | 8/2003 |
| WO | 2003075836 A2 | 9/2003 |
| WO | 2003076424 A1 | 9/2003 |
| WO | 2003077914 A1 | 9/2003 |
| WO | 2004002453 A1 | 1/2004 |
| WO | 2004029213 A2 | 4/2004 |
| WO | 2004091515 A2 | 10/2004 |
| WO | 2005021749 A1 | 3/2005 |
| WO | 2005028443 A2 | 3/2005 |
| WO | 2006/031977 | 3/2006 |
| WO | 2006028958 A2 | 3/2006 |
| WO | 2006031977 A2 | 3/2006 |
| WO | 2006086772 A2 | 8/2006 |
| WO | 2006122806 A2 | 11/2006 |
| WO | 2007014011 A2 | 2/2007 |
| WO | 2007128477 A2 | 11/2007 |
| WO | WO2008/109460 | 8/2008 |
| WO | 2008109460 A2 | 9/2008 |
| WO | 2008132234 A2 | 11/2008 |
| WO | 2008/156702 | 12/2008 |
| WO | 2008147824 A2 | 12/2008 |
| WO | 2008156702 A2 | 12/2008 |
| WO | 2009036082 A2 | 3/2009 |
| WO | 2009055730 A1 | 4/2009 |
| WO | 2009082817 A1 | 7/2009 |
| WO | 2009155386 A1 | 12/2009 |
| WO | 2010/146055 | 12/2010 |
| WO | 2010146055 A1 | 12/2010 |
| WO | 2011044671 A1 | 4/2011 |
| WO | 2011073326 A2 | 6/2011 |
| WO | 2001068836 A2 | 9/2011 |
| WO | 2012006243 A2 | 1/2012 |
| WO | WO2012/006243 | 1/2012 |

OTHER PUBLICATIONS

Briscoe et al. (1995) The American Physiological Society; 268(3); L374-L380.
Burgin et al. 1996 Biochemistry 35: 14090-14097.
Caplen et al. 2001 Proc. Natl. Acad. Sci. (USA), 98: 9742-9747.
Chan et al. 1999 Nature Genet. 21: 410-413.
Chenn et al. 2003 Cer. Cortex 13: 599-606.
Chiu and Rana 2003 RNA 9: 1034-1048.
Clements et al. 2002 Cancer Res. 62: 3503-6.
Clevers 2006 Cell 127: 469-480.
Delektorskaya et al. 2008. Bull. Exp. Biol. Med. 146: 616-619.
Devroe et al. 2002. BMC Biotechnol. 2:15, pp. 1-5.
Donze and Picard, 2002, 30(10): e46.
Duxbury et al., J. Surgical Research, 2004, 117: 339-344.
Elbashir et al. 2001 Genes Dev. 15: 188-200.
Elbashir et al. 2001 EMBO J. 20: 6877-6888.
Elbashir et al. 2001 Nature 411: 494-498.
Farhood, et al., Biochimica et Biophysica Acta, 1235, (1995), 289-295.
Fuchs 2009 Cell 137: 811-819.
Fukuchi et al. 1998 Cancer Res. 58: 3526-3528.
Funayama et al. 1995 J. Cell Biol. 128: 959-968.
Garcia-Rostan et al. 1999 Cancer Res. 59: 1811-1815.
Gautier et al. 1987 Nucleic Acids. Res. 15: 6625-6641.
Ha et al. 2002 Acta Derm. Venereol. 82: 428-431.
Hamaguchi et al. 1993 EMBO J. 12:307-314.
Harborth et al. 2003 Anti-sense & Nucleic Acid Drug Development 13: 83-105.
He et al. 1998 Science 281: 1509-1512.
He et al. 2004 Develop. 131: 1663-1677.
Helene 1991 Anticancer Drug Des. 6(6) : 569-84.
Helene et al. 1992 Ann. N.Y. Acad. Sci. 660: 27-36.
Hu-Lieskovan et al. 2005 Cancer Res. 65: 8984-8992.
Huang et al. 2008. Curr. Opin. Cell Biol. 20: 119-125.
Hutvagner et al. 2001 Science 293: 834-838.
Inoue et al. 1987 Nucleic Acids Res. 15: 6131-6148.
Inoue et al. 1987 FEBS Lett. 215: 327-330.
Iwao et al. 1998 Cancer Res. 58: 1021-1026.
Kawanishi et al. 1995 Mol. Cell. Biol. 15: 1175-1181.
Keinanen, K; Laukkanen, M.L. (1994) FEBS Lett. 346: 123-126.
Khramtsov et al. 2010 Am. J. Pathol. 176: 2911-2920.
Killion, J.J.; Fidler, I.J. (1994) Immunomethods 4: 273-279.
Kraus et al. 1994. Genomics 23: 272-274.
Kraynack et al. 2006 RNA 12:163-176.
Li et al. 2002 Gene 283: 255-62.
Li et al. 2005 World J. Gastroent. 11: 2117-23.
Liu et al. 2010 J. Dental Res. 89: 318-330.
Logan et al. 2004 Ann. Rev. Cell. Dev. Biol. 20: 781-810.
Lovell et al. 2011 Nature Mater. 10: 324-32.
Maher 1992, Bioassays 14(12) : 807-15.
Martinez et al. 2002 Cell, 110, 563-574.
Matsuyoshi et al. 1992 J. Cell Biol. 118: 703-714.
McCaffrey et al., Nature, 2002, 418(6893):38-39.
McDonald et al. 2009 Dev. Cell 17: 9-26.

(56) References Cited

OTHER PUBLICATIONS

Miller, et al., Biochemistry, 1998, 37(37): 12875-83.
Miyaki et al. 1999 Cancer Res. 59: 4506-4509.
Miyoshi et al. 1998 Cancer Res. 58: 2524-2527.
Moon et al. 2002 science 296: 1644-1646.
Moon et al. 2004 Nat. Rev. Genet. 5: 689-699.
Munemitsu et al. 1995 Proc. Natl. Acad. Sci. USA 92:3046-3050.
Munemitsu et al. 1996 Mol. Cell. Biol. 16: 4088-4094.
Nelson et al. 2004 Science 303: 1483-1487.
Noda et al. 1009 Br. J. Cancer 100: 1647-1658.
Niyakanen et al. 2001 Cell 107:309-321.
Ovcharenko, D.; "Efficient delivery of siRNAs to human primary cells: Electroporation Vs. Chemical Transfection", Ambion ; pp. 1-4.
Owais, M. et al. (1995) Antimicrob. Agents Chemother. 39: 180-184.
Palacios et al. 1998 Cancer Res. 58: 1344-1347.
Parrish et al. 2000 Molecular Cell 6: 1077-1087.
Bloeman, P.G., et al. (1995) FEBS Lett. 357: 140-144.
POLAKISS 2007. Curr. Opin. Genet. Dev. 17: 45-51.
Rubinfeld et al. 1997 Science 275: 1790-1792.
Saegusa et al. 2009 Am. J. Pathol. 174: 2107-2115.
Saldanha et al. 2004; Br. J. Dermatol. 151: 157-64.
Schiffelers et al. 2004 Nucl. Acids Res. 32: el49, pp. 1-10.
Schreier et al. (1994) J. Biol. Chem. 269: 9090-9098.
Sharp et al. 2001 Genes Dev. 15:485-490.
Sioud 2005 J. Mol. Biol. 348:1079-1090.
Sioud and Sorensen, Biochem Biophys Res Commun. 2003, 312(4):1220-1225.
Sommers et al. 1994 Cancer Res. 54: 3544-3552.
Song et al.,2003 Nature Medicine, vol. 9, No. 3, 347-351.
Song et al. 2005 Nat Biotech. 23: 709-717.
Soutschek et al. 2004 Nature 432: 173-178.
Stojadinovic et al. Am. J. Pathol. 167: 59-69.
Thompson et al. 2007 Hepatology 45: 1298-305.
Umezawa et al., (1988) Biochem. Biophys. Res. Commun. 153: 1038-1044.
Usman et al. 1994 Nucleic Acids Symp. Ser. 31: 163-164.
Ranade, V.V. (1989) J. Clin. Pharmacol. 29: 685-694.
Voeller et al. 1998 Cancer Res. 2520-2523.
Wang et al. 2008 Cancer Epidemiol. Biomarkers Prev. 17: 2101-8.
Xia et al. 2002 Nat. Biotechnol. 20, 1006-1010.
Yost et al. 1996 Genes Dev. 10: 1443-1454.
Zurawel et al. 1998 Cancer Res. 58: 896-899.
Henschel et al. 2004 DeQor: a web-based tool for the design and quality control of siRNAs. Nucleic Acids Research 32 (Web Server Issue): W113-W120.
Usman, N., and Cedergren, R. 1992; 17(9):334-339.
Examination Report for corresponding Australian Application AU2013208720.
Examination Report 2 for corresponding Australian Application AU2013208720.
Office Action for corresponding Chinese Application CN201380013297.9.
Written Opinion for corresponding International Application WO2013105022.
Third Office Action for corresponding Chinese Application No. 201380013297.9 dated Mar. 20, 2017.
Office Action for corresponding Japanese Application No. 2014-551706 dated Nov. 8, 2016.
Communication for corresponding European Patent Application No. 13704633.0 dated Sep. 14, 2016.
Office Action for corresponding European Application No. 13704633.0 dated Jan. 29, 2018.
Office Action for corresponding European Application No. 13704633.0 dated Mar. 23, 2017.
Second Office Action for corresponding Chinese Patent Application No. 201380013297.9 dated Jul. 5, 2016.

* cited by examiner

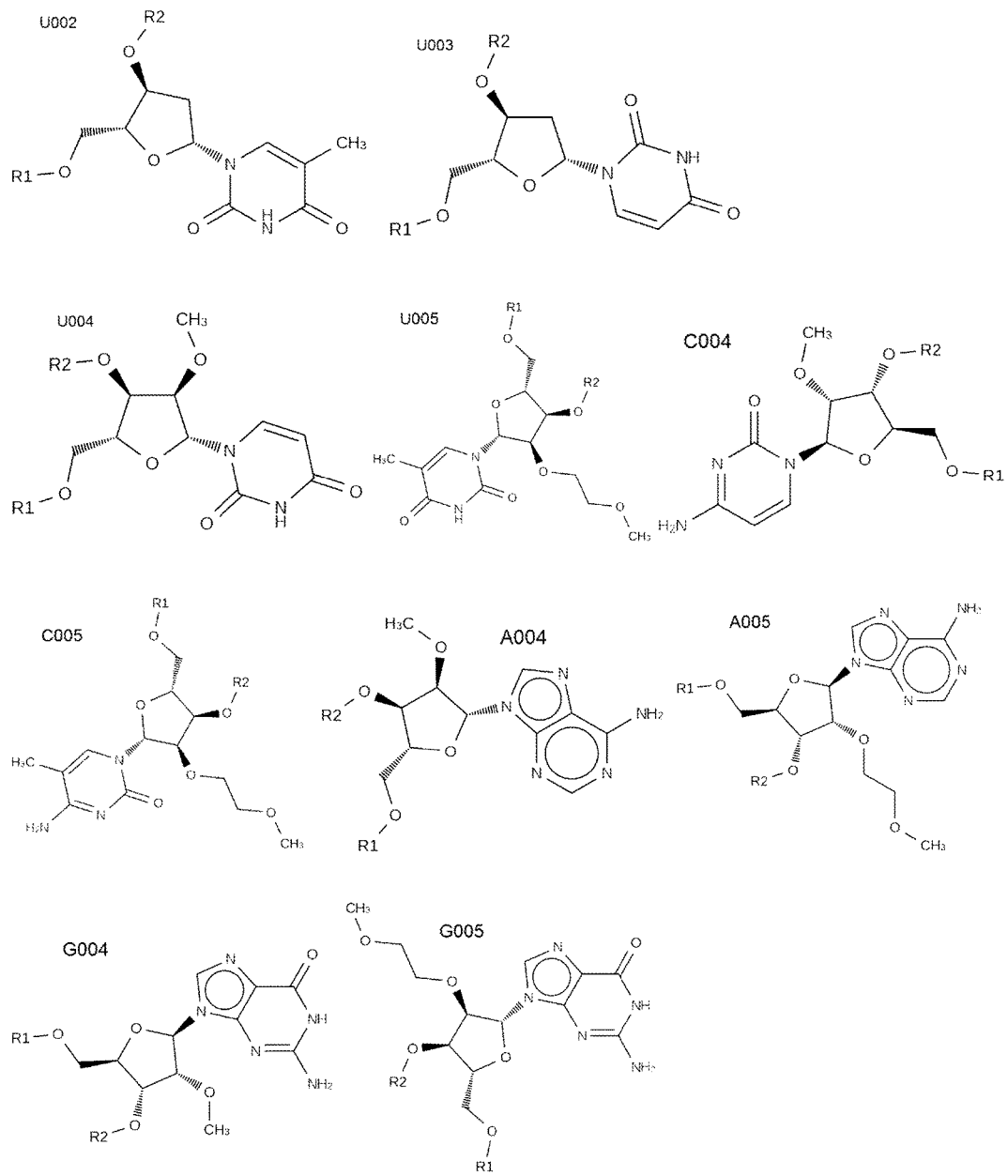

ies. Indeed, APC deletion or Beta-catenin activation in stem cells is essential for intestinal neoplasia. Fuchs 2009 Cell 137: 811-819.

ORGANIC COMPOSITIONS TO TREAT BETA-CATENIN-RELATED DISEASES

This application is a U.S. National Phase filing of International Application No. PCT/IB2013/050159 filed 8 Jan. 2013, which claims priority to U.S. Application No. 61/584,530 filed 9 Jan. 2012 and 61/598,530 filed 14 Feb. 2012, the contents of which are incorporated herein by reference in their entirety.

SEQUENCE LISTING

The instant application contains a Sequence Listing which has been submitted in ASCII format via EFS-Web and is hereby incorporated by reference in its entirety. Said ASCII copy, created on Apr. 10, 2013, is named PAT054417-WO-PCT_SL.txt and is 1,553,980 bytes in size.

BACKGROUND OF THE INVENTION

Signaling by the Wnt family of secreted glycolipoproteins is one of the fundamental mechanisms that direct cell proliferation, cell polarity, and cell fate determination during embryonic development and tissue homeostasis. As a result, mutations in the Wnt pathway are often linked to human birth defects, cancer, and other diseases. A critical Wnt pathway is the canonical Wnt signaling pathway.

The transcriptional co-activator Beta-Catenin is the molecular node in this pathway. In the absence of Wnt, cytoplasmic Beta-catenin protein is constantly degraded by the action of the Axin complex, which is composed of the scaffolding protein Axin, the tumor suppressor adenomatous polyposis coli gene product (APC), casein kinase 1 (CK1), and glycogen synthase kinase 3 (GSK3). CK1 and GSK3 sequentially phosphorylate the amino terminal region of Beta-catenin, resulting in Beta-catenin recognition by Beta-Trcp, an E3 ubiquitin ligase subunit, and subsequent Beta-catenin ubiquitination and proteasomal degradation.

This continual elimination of Beta-catenin prevents Beta-catenin from reaching the nucleus, and Wnt target genes are thereby repressed by the DNA-bound T cell factor/lymphoid enhancer factor (TCF/LEF) family of proteins. The Wnt/Beta-catenin pathway is activated when a Wnt ligand binds to the seven-pass transmembrane Frizzled (Fz or Fzd) receptor and its coreceptor, low-density lipoprotein receptor-related protein 6 (LRP6), or its close relative LRP5. The formation of a likely Wnt-Fz-LRP6 complex, together with the recruitment of the scaffolding protein Dishevelled (Dvl), results in LRP6 phosphorylation and activation and the recruitment of the Axin complex to the receptors. These events lead to inhibition of Axin-mediated Beta-catenin phosphorylation and thereby to the stabilization of Beta-catenin, which accumulates, travels to the nucleus to form complexes with TCF/LEF and activates Wnt target gene expression.

Given the critical roles of Wnt/Beta-catenin signaling in development and homeostasis, it is no surprise that mutations of the Wnt pathway components are associated with many disorders and diseases. McDonald et al. 2009 Dev. Cell 17: 9-26. Association of deregulated Wnt/Beta-catenin signaling with cancer has been well documented, particularly with colorectal cancer. Polakis 2007. Curr. Opin. Genet. Dev. 17: 45-51. Constitutively activated Beta-catenin signaling, due to APC deficiency or Beta-catenin mutations that prevent its degradation, leads to excessive stem cell renewal/proliferation that predisposes cells to tumorigenesis. Indeed, APC deletion or Beta-catenin activation in stem cells is essential for intestinal neoplasia. Fuchs 2009 Cell 137: 811-819.

Mutations in Beta-Catenin, alterations of levels and cellular compartmentalization of Beta-Catenin, and other aberrations of the Wnt/Beta-Catenin pathway are thus involved directly or indirectly with many diseases. In some Beta-Catenin-related cancers, Beta-Catenin is required for tumor growth but is not amplified, over-expressed or mis-localized.

There exists the need for treatments related to Beta-Catenin-related diseases.

BRIEF SUMMARY OF THE INVENTION

The present disclosure provides RNAi (RNA interference) agents to Beta-Catenin, for inhibition of the target gene Beta-Catenin, which are useful in the treatment of Beta-Catenin-related diseases, such as adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing, and similar and related diseases. The present disclosure also encompasses a method of treating a human subject having a pathological state mediated at least in part by Beta-Catenin expression, the method comprising the step of administering to the subject a therapeutically effect amount of a RNAi agent to Beta-Catenin.

The present disclosure provides specific RNAi agents and methods that are useful in reducing Beta-Catenin levels in a subject, e.g., a mammal, such as a human. The present disclosure specifically provides double-stranded RNAi agents comprising at least 15 or more contiguous nucleotides of Beta-Catenin. In particular, the present disclosure provides agents comprising a sense strand and an anti-sense strand, wherein the sense strand and/or the anti-sense strand comprise sequences of 15 or more contiguous nucleotides differing by 0, 1, 2 or 3 from those of the RNAi agents provided, e.g., in Table 1 or elsewhere herein, and modified and unmodified variants thereof. Unmodified sequences are sometimes referred to as "generic". The present disclosure also provides agents comprising a sense strand and an anti-sense strand, wherein the sense strand and/or the anti-sense strand comprise sequences of 19 or more contiguous nucleotides differing by 0, 1, 2 or 3 from those of the RNAi agents provided, e.g., in Table 1 or elsewhere herein, and modified and unmodified variants thereof. The sense strand and anti-sense strand can be contiguous, or covalently bound, e.g., via a loop or linker. The RNAi agents particularly can in one embodiment comprise less than about 30 nucleotides per strand, e.g., such as 17 to 23 nucleotides, 18 to 22 nucleotides, 17 to 23 nucleotides, and/or 19 to 21 nucleotides, and/or 19 to 30 nucleotides, and/or such as those provided, e.g., in Tables 1, 2, 3, 4, 5, 6, 7, 8 and/or 9 or elsewhere herein.

The double-stranded RNAi agents can have 0, 1 or 2 blunt ends, and/or overhangs of 1, 2, 3 or 4 nucleotides (i.e., 1 to 4 nt) from one or both 3' and/or 5' ends. The double-stranded RNAi agents can also optionally comprise one or two 3' caps and/or one or more modified nucleotides. Modified variants of sequences as provided herein include those that are otherwise identical but contain substitutions of a naturally-occurring nucleotide for a corresponding modified nucleotide.

Further, the RNAi agent can either contain only naturally-occurring ribonucleotide subunits, or one or more modifications to the sugar, phosphate or base of one or more of the replacement nucleotide subunits, whether they comprise ribonucleotide subunits or deoxyribonucleotide subunits. In one embodiment, modified variants of the disclosed RNAi agents have a thymidine (as RNA, or, preferably, DNA) replacing a uridine. In one embodiment, modified variants of the disclosed RNAi agents include RNAi agents with the same sequence (e.g., the same sequence of bases), but with one or more modifications to one or more of the sugar, phosphate or base of one or more of the nucleotide subunits. In one embodiment, the modifications improve efficacy, stability (e.g., against nucleases in blood serum and/or intestinal fluid), and/or reduce immunogenicity of the RNAi agent. One aspect of the present disclosure relates to a double-stranded oligonucleotide comprising at least one non-natural nucleobase. In certain embodiments, the non-natural nucleobase is difluorotolyl, nitroindolyl, nitropyrrolyl, or nitroimidazolyl. In a particular embodiment, the non-natural nucleobase is difluorotolyl. In certain embodiments, only one of the two oligonucleotide strands contains a non-natural nucleobase. In certain embodiments, both of the oligonucleotide strands contain a non-natural nucleobase.

The RNAi agent(s) can optionally be attached to a ligand selected to improve one or more characteristics, e.g., stability, distribution and/or cellular uptake of the agent, e.g. cholesterol or a derivative thereof. The RNAi agent(s) can be isolated or part of a pharmaceutical composition used for the methods described herein. The pharmaceutical compositions can optionally comprise two or more RNAi agents, each one directed to the same or a different segment the Beta-Catenin mRNA. Optionally, the pharmaceutical compositions can further comprise or be used in conjunction with any known treatment for any Beta-Catenin-related disease.

The present disclosure further provides methods for reducing the level of Beta-Catenin mRNA in a cell, particularly in the case of a disease characterized by over-expression or hyper-activity of Beta-Catenin. Such methods comprise the step of administering one or more of the RNAi agents of the present disclosure to a cell, as further described below. The present methods utilize the cellular mechanisms involved in RNA interference to selectively degrade the target RNA in a cell and are comprised of the step of contacting a cell with one of the RNAi agents of the present disclosure. The present disclosure also encompasses a method of treating a human subject having a pathological state mediated at least in part by Beta-Catenin expression, over-expression, hyper-activity or improper cellular compartmentalization, the method comprising the step of administering to the subject a therapeutically effect amount of a RNAi agent to Beta-Catenin. Additional methods involve a pathological state wherein disease progression (e.g., tumor growth) requires Beta-Catenin, although Beta-Catenin is not amplified, over-expressed or mis-localized. Such methods can be performed directly on a cell or can be performed on a mammalian subject by administering to a cell or a subject one or more of the RNAi agents/pharmaceutical compositions of the present disclosure. Reduction of target Beta-Catenin RNA in a cell results in a reduction in the amount of encoded Beta-Catenin protein produced. In an organism, this can result in restoration of balance in the Wnt/Beta-Catenin pathway, and/or prevention of Beta-Catenin accumulation, and/or restoration of proper cell compartmentalization of Beta-Catenin, and/or a reduction in Beta-Catenin activity and/or expression, and/or prevention of Beta-Catenin-mediated activation of Wnt-related genes such as the proto-oncogene c-myc, and/or amelioration, treatment and/or prevention of a Beta-Catenin-related disease. In some Beta-Catenin-related cancers, Beta-Catenin is required for tumor growth but is not amplified, over-expressed or mis-localized. A reduction in Beta-Catenin expression, level or activity should thus limit tumor growth.

The methods and compositions of the present disclosure, e.g., the methods and Beta-Catenin RNAi agent compositions, can be used with any dosage and/or formulation described herein, as well as with any route of administration described herein.

The details of one or more embodiments of the present disclosure are set forth in the accompanying drawings and the description below. Elements of the various embodiments (e.g., sequences, modifications, endcaps, combinations of RNAi agents, ligands, additional treatments or methods which can be used, etc.) which are not mutually-exclusive can be combined with each other. Combinations which are mutually exclusive include, for example, the fact that a RNAi agent comprising two strands cannot by definition have both two blunt ends and two overhangs. Furthermore, any RNAi agent sequence can be combined with any set of modifications or endcaps disclosed herein, provided the elements of the combination are not mutually exclusive. Any combination of modifications, 5' end caps, and/or 3' end caps can be used with any RNAi agent sequence disclosed herein. Any RNAi agent can be combined with any other RNAi agent or other treatment composition or method. Other features, objects, and advantages of the present disclosure will be apparent from this description, the drawings, and from the claims.

BRIEF DESCRIPTION OF THE FIGURES

FIG. 1 illustrates various modified nucleotides: U002, U003, U004, U005, C004, C005, A004, A005, G005, and G004, which can be used in the RNAi agents disclosed herein. U002 indicates a 2'-deoxy-thymidine which is DNA. U003 indicates 2'-deoxy uridine. U004 indicates a nucleotide with a U base with a 2'-O-methyl modification. U005 indicates a U base with a 2'-O-methoxyethyl (MOE) modification. C004 indicates a C base with a 2'-O-methyl modification. C005 indicates a C base with 2'-O-methoxyethyl modification. A004 indicates an A base with a 2'-O-methyl modification. A005 indicates an A base with 2'-O-methoxyethyl modification. G005 indicates a G base with a 2'O-methyl modification. G004 indicates a G base with a 2'O-methyl modification. Polynucleotide sequences written with the symbols U002, U003, U004, etc. are sometimes prefaced by "X" (indicating the start of the sequence), and sometimes have a "p" between the bases, indicating the phosphodiester bond between nucleosides.

DETAILED DESCRIPTION OF THE INVENTION

The present disclosure encompasses RNAi agents to Beta-Catenin, for inhibition of the target gene Beta-Catenin, which are useful in treatment of Beta-Catenin-related diseases (e.g., diseases associated with mutations in and/or altered expression, compartmentalization, level and/or activity of Beta-Catenin, and/or diseases treatable by modulating the expression, level and/or activity of Beta-Catenin), such as adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing, and similar and related diseases. In some Beta-Catenin-related cancers, Beta-Catenin is required for tumor growth but is not amplified, over-expressed or mis-localized. A reduction in Beta-Catenin expression, level or activity should thus limit tumor growth. The present disclosure also encompasses a method of treating a human subject having a pathological state mediated at least in part by Beta-Catenin expression, the method comprising the step of administering to the subject a therapeutically effect amount of a RNAi agent to Beta-Catenin.

Various Embodiments of the Present Disclosure Include

RNAi Agent Comprising an Anti-Sense Strand of a RNAi Agent Described Herein.

In one embodiment, the present disclosure relates to a composition comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-Catenin (or any set of overlapping RNAi agents specific to Beta-Catenin) provided, e.g., in Tables 1, 2, 3, 4, 5, 6, 7, 8 and/or 9. In another embodiment, the present disclosure relates to a composition comprising a RNAi agent comprising a sense and an anti-sense strand, wherein the sense strand comprises at least 15 contiguous nucleotides differing by 0, 1, 2, or 3 nucleotides from the sense strand of a RNAi agent from any sequence provided herein. In another embodiment, the present disclosure relates to a composition comprising a RNAi agent comprising a first strand and a second strand, wherein the first strand comprises at least 15 contiguous nucleotides differing by 0, 1, 2, or 3 nucleotides from the sequence of the first strand, and the second strand comprises at least 15 contiguous nucleotides differing by 0, 1, 2, or 3 nucleotides from the sequence of the second strand of any RNAi agent provided herein. In another embodiment, the present disclosure relates to a composition comprising a RNAi agent comprising a first strand and a second strand, wherein the sequence of the first strand comprises the sequence of the first strand of any RNAi agent provided herein. In another embodiment, the present disclosure relates to a composition comprising a RNAi agent comprising a first strand and a second strand, wherein the sequence of the first strand is the sequence of the first strand of any RNAi agent provided herein. In another embodiment, the present disclosure relates to a composition comprising a RNAi agent comprising a first strand and a second strand, wherein the sequences of the first and/or second strands comprise the sequences of the first and/or second strand of any RNAi agent provided herein. In another embodiment, the present disclosure relates to a composition comprising a RNAi agent comprising a first strand and a second strand, wherein the sequences of the first and/or second strand are the sequences of the first and/or second strand of any RNAi agent provided herein. In these various embodiments, the RNAi agent is for inhibition of the target gene Beta-Catenin.

Particular duplexes include the unmodified and example modified sequences listed in Table 1. In addition to the described example modifications, other modified variants can be made using the nucleotide sequences provided.

TABLE 1

SEQ ID NOs. for RNAi Agents to Beta-Catenin
Provided in Table 1 are the nickname of various Beta-Catenin RNAi duplexes; the unmodified sense and anti-sense sequences and SEQ ID NOs; an example modified sense and antisense sequence and SEQ ID NOs; and the position of the RNAi agent within the Beta-Catenin gene.

| | UNMODIFIED SEQUENCE | | EXAMPLE MODIFIED SEQUENCE | | |
|---|---|---|---|---|---|
| DUPLEX | Sense SEQ ID NO: | Anti-sense SEQ ID NO: | Sense SEQ ID NO: | Anti-sense SEQ NO: | Position |
| AD-18892 | 4771 | 5430 | 1 | 6497 | 2500 |
| AD-18893 | 4772 | 5431 | 2 | 661 | 1659 |
| AD-18894 | 4773 | 5432 | 3 | 662 | 3038 |
| AD-18895 | 4774 | 5433 | 4 | 663 | 2096 |
| AD-18896 | 4775 | 5434 | 5 | 664 | 265 |
| AD-18897 | 4776 | 5435 | 6 | 665 | 1797 |
| AD-18898 | 4777 | 5436 | 7 | 666 | 2587 |
| AD-18899 | 4778 | 5437 | 8 | 667 | 1541 |
| AD-18900 | 4779 | 5438 | 9 | 668 | 2391 |
| AD-18901 | 4780 | 5439 | 10 | 669 | 954 |
| AD-18902 | 4781 | 5440 | 11 | 670 | 2908 |
| AD-18903 | 4782 | 5441 | 12 | 671 | 3104 |
| AD-18904 | 4783 | 5442 | 13 | 672 | 1665 |
| AD-18905 | 4784 | 5443 | 14 | 673 | 2594 |
| AD-18906 | 4785 | 5444 | 15 | 674 | 3147 |
| AD-18907 | 4786 | 5445 | 16 | 675 | 2592 |
| AD-18908 | 4787 | 5446 | 17 | 676 | 2507 |
| AD-18909 | 4788 | 5447 | 18 | 677 | 2325 |
| AD-18910 | 4789 | 5448 | 19 | 678 | 2326 |
| AD-18911 | 4790 | 5449 | 20 | 679 | 577 |
| AD-18912 | 4791 | 5450 | 21 | 680 | 2116 |
| AD-18913 | 4792 | 5451 | 22 | 681 | 2708 |
| AD-18914 | 4793 | 5452 | 23 | 682 | 2912 |
| AD-18915 | 4794 | 5453 | 24 | 683 | 2704 |
| AD-18916 | 4795 | 5454 | 25 | 684 | 3146 |
| AD-18917 | 4796 | 5455 | 26 | 685 | 1542 |
| AD-18918 | 4797 | 5456 | 27 | 686 | 621 |
| AD-18919 | 4798 | 5457 | 28 | 687 | 2505 |
| AD-18920 | 4799 | 5458 | 29 | 688 | 2590 |
| AD-18921 | 4800 | 5459 | 30 | 689 | 3099 |
| AD-18922 | 4801 | 5460 | 31 | 690 | 2591 |
| AD-18923 | 4802 | 5461 | 32 | 691 | 2112 |
| AD-18925 | 4803 | 5462 | 33 | 692 | 366 |
| AD-18926 | 4804 | 5463 | 34 | 693 | 2479 |
| AD-18927 | 4805 | 5464 | 35 | 694 | 1502 |
| AD-18928 | 4806 | 5465 | 36 | 695 | 2073 |
| AD-18929 | 4807 | 5466 | 37 | 696 | 2702 |
| AD-18930 | 4808 | 5467 | 38 | 697 | 1774 |
| AD-18931 | 4809 | 5468 | 39 | 698 | 708 |
| AD-18932 | 4810 | 5469 | 40 | 699 | 1667 |
| AD-18933 | 4811 | 5470 | 41 | 700 | 2629 |
| AD-18934 | 4812 | 5471 | 42 | 701 | 2114 |
| AD-18935 | 4813 | 5472 | 43 | 702 | 2706 |
| AD-18936 | 4814 | 5473 | 44 | 703 | 2899 |
| AD-18937 | 4815 | 5474 | 45 | 704 | 1639 |
| AD-18938 | 4816 | 5475 | 46 | 705 | 1638 |
| AD-18939 | 4817 | 5476 | 47 | 706 | 2906 |
| AD-18940 | 4818 | 5477 | 48 | 707 | 3145 |
| AD-18941 | 4819 | 5478 | 49 | 708 | 2390 |
| AD-18942 | 4820 | 5479 | 50 | 709 | 2707 |
| AD-18943 | 4821 | 5480 | 51 | 710 | 1668 |
| AD-18944 | 4822 | 5481 | 52 | 711 | 2506 |
| AD-18945 | 4823 | 5482 | 53 | 712 | 1286 |
| AD-18946 | 4824 | 5483 | 54 | 713 | 1660 |
| AD-18947 | 4825 | 5484 | 55 | 714 | 2328 |
| AD-18948 | 4826 | 5485 | 56 | 715 | 1776 |
| AD-18949 | 4827 | 5486 | 57 | 716 | 619 |
| AD-18950 | 4828 | 5487 | 58 | 717 | 807 |
| AD-18951 | 4829 | 5488 | 59 | 718 | 2417 |
| AD-18952 | 4830 | 5489 | 60 | 719 | 3165 |
| AD-18953 | 4831 | 5490 | 61 | 720 | 266 |

TABLE 1-continued

SEQ ID NOs. for RNAi Agents to Beta-Catenin
Provided in Table 1 are the nickname of various Beta-Catenin RNAi
duplexes; the unmodified sense and anti-sense sequences and SEQ ID NOs;
an example modified sense and antisense sequence and SEQ ID NOs;
and the position of the RNAi agent within the Beta-Catenin gene.

| | UNMODIFIED SEQUENCE | | EXAMPLE MODIFIED SEQUENCE | | |
|---|---|---|---|---|---|
| DUPLEX | Sense SEQ ID NO: | Anti-sense SEQ ID NO: | Sense SEQ ID NO: | Anti-sense SEQ ID NO: | Position |
| AD-18954 | 4832 | 5491 | 62 | 721 | 618 |
| AD-18955 | 4833 | 5492 | 63 | 722 | 2113 |
| AD-18956 | 4834 | 5493 | 64 | 723 | 3040 |
| AD-18957 | 4835 | 5494 | 65 | 724 | 3166 |
| AD-18958 | 4836 | 5495 | 66 | 725 | 3041 |
| AD-18959 | 4837 | 5496 | 67 | 726 | 582 |
| AD-18960 | 4838 | 5497 | 68 | 727 | 3220 |
| AD-18961 | 4839 | 5498 | 69 | 728 | 2125 |
| AD-18962 | 4840 | 5499 | 70 | 729 | 2101 |
| AD-18963 | 4841 | 5500 | 71 | 730 | 1773 |
| AD-18964 | 4842 | 5501 | 72 | 731 | 2588 |
| AD-18965 | 4843 | 5502 | 73 | 732 | 2598 |
| AD-18966 | 4844 | 5503 | 74 | 733 | 2907 |
| AD-18967 | 4845 | 5504 | 75 | 734 | 2508 |
| AD-18968 | 4846 | 5505 | 76 | 735 | 3102 |
| AD-18969 | 4847 | 5506 | 77 | 736 | 3042 |
| AD-18970 | 4848 | 5507 | 78 | 737 | 2499 |
| AD-18971 | 4849 | 5508 | 79 | 738 | 2124 |
| AD-18972 | 4850 | 5509 | 80 | 739 | 3105 |
| AD-18973 | 4851 | 5510 | 81 | 740 | 2119 |
| AD-18974 | 4852 | 5511 | 82 | 741 | 641 |
| AD-18975 | 4853 | 5512 | 83 | 742 | 2584 |
| AD-18976 | 4854 | 5513 | 84 | 743 | 2105 |
| AD-18977 | 4855 | 5514 | 85 | 744 | 1069 |
| AD-18978 | 4856 | 5515 | 86 | 745 | 2330 |
| AD-18979 | 4857 | 5516 | 87 | 746 | 2388 |
| AD-18980 | 4858 | 5517 | 88 | 747 | 3224 |
| AD-18981 | 4859 | 5518 | 89 | 748 | 3098 |
| AD-18982 | 4860 | 5519 | 90 | 749 | 2049 |
| AD-18983 | 4861 | 5520 | 91 | 750 | 1796 |
| AD-18984 | 4862 | 5521 | 92 | 751 | 2127 |
| AD-18985 | 4863 | 5522 | 93 | 752 | 3029 |
| AD-18986 | 4864 | 5523 | 94 | 753 | 2596 |
| AD-18987 | 4865 | 5524 | 95 | 754 | 3221 |
| AD-18988 | 4866 | 5525 | 96 | 755 | 3159 |
| AD-18989 | 4867 | 5526 | 97 | 756 | 2583 |
| AD-18990 | 4868 | 5527 | 98 | 757 | 1655 |
| AD-18991 | 4869 | 5528 | 99 | 758 | 874 |
| AD-18992 | 4870 | 5529 | 100 | 759 | 3028 |
| AD-18993 | 4871 | 5530 | 101 | 760 | 3037 |
| AD-18994 | 4872 | 5531 | 102 | 761 | 1504 |
| AD-18995 | 4873 | 5532 | 103 | 762 | 3095 |
| AD-18996 | 4874 | 5533 | 104 | 763 | 2703 |
| AD-18997 | 4875 | 5534 | 105 | 764 | 3154 |
| AD-18998 | 4876 | 5535 | 106 | 765 | 3094 |
| AD-18999 | 4877 | 5536 | 107 | 766 | 2599 |
| AD-19000 | 4878 | 5537 | 108 | 767 | 643 |
| AD-19001 | 4879 | 5538 | 109 | 768 | 2389 |
| AD-19002 | 4880 | 5539 | 110 | 769 | 1669 |
| AD-19003 | 4881 | 5540 | 111 | 770 | 2106 |
| AD-19004 | 4882 | 5541 | 112 | 771 | 3170 |
| AD-19005 | 4883 | 5542 | 113 | 772 | 3103 |
| AD-19006 | 4884 | 5543 | 114 | 773 | 642 |
| AD-19007 | 4885 | 5544 | 115 | 774 | 3230 |
| AD-19008 | 4886 | 5545 | 116 | 775 | 3222 |
| AD-19009 | 4887 | 5546 | 117 | 776 | 2905 |
| AD-19010 | 4888 | 5547 | 118 | 777 | 2904 |
| AD-19011 | 4889 | 5548 | 119 | 778 | 579 |
| AD-19012 | 4890 | 5549 | 120 | 779 | 3171 |
| AD-19042 | 4891 | 5550 | 121 | 780 | 2504 |
| AD-19043 | 4892 | 5551 | 122 | 781 | 3039 |
| AD-19044 | 4893 | 5552 | 123 | 782 | 3034 |
| AD-19045 | 4894 | 5553 | 124 | 783 | 1505 |
| AD-19046 | 4895 | 5554 | 125 | 784 | 1288 |
| AD-19047 | 4896 | 5555 | 126 | 785 | 2123 |
| AD-19048 | 4897 | 5556 | 127 | 786 | 620 |
| AD-19049 | 4898 | 5557 | 128 | 787 | 3164 |
| AD-19050 | 4899 | 5558 | 129 | 788 | 3101 |
| AD-19051 | 4900 | 5559 | 130 | 789 | 2329 |
| AD-19052 | 4901 | 5560 | 131 | 790 | 2115 |
| AD-19053 | 4902 | 5561 | 132 | 791 | 2627 |
| AD-19054 | 4903 | 5562 | 133 | 792 | 2902 |
| AD-19055 | 4904 | 5563 | 134 | 793 | 262 |
| AD-19056 | 4905 | 5564 | 135 | 794 | 1406 |
| AD-19057 | 4906 | 5565 | 136 | 795 | 2497 |
| AD-19058 | 4907 | 5566 | 137 | 796 | 3043 |
| AD-19059 | 4908 | 5567 | 138 | 797 | 2589 |
| AD-19060 | 4909 | 5568 | 139 | 798 | 2586 |
| AD-19061 | 4910 | 5569 | 140 | 799 | 1658 |
| AD-19062 | 4911 | 5570 | 141 | 800 | 2050 |
| AD-19063 | 4912 | 5571 | 142 | 801 | 2385 |
| AD-19064 | 4913 | 5572 | 143 | 802 | 1637 |
| AD-19065 | 4914 | 5573 | 144 | 803 | 707 |
| AD-19066 | 4915 | 5574 | 145 | 804 | 2597 |
| AD-19067 | 4916 | 5575 | 146 | 805 | 3161 |
| AD-19068 | 4917 | 5576 | 147 | 806 | 875 |
| AD-19069 | 4918 | 5577 | 148 | 807 | 3044 |
| AD-19070 | 4919 | 5578 | 149 | 808 | 617 |
| AD-19071 | 4920 | 5579 | 150 | 809 | 2498 |
| AD-19072 | 4921 | 5580 | 151 | 810 | 367 |
| AD-19073 | 4922 | 5581 | 152 | 811 | 2545 |
| AD-19074 | 4923 | 5582 | 153 | 812 | 1544 |
| AD-19075 | 4924 | 5583 | 154 | 813 | 3148 |
| AD-19076 | 4925 | 5584 | 155 | 814 | 2909 |
| AD-19077 | 4926 | 5585 | 156 | 815 | 2509 |
| AD-19078 | 4927 | 5586 | 157 | 816 | 1775 |
| AD-19079 | 4928 | 5587 | 158 | 817 | 1407 |
| AD-19080 | 4929 | 5588 | 159 | 818 | 2327 |
| AD-19081 | 4930 | 5589 | 160 | 819 | 3031 |
| AD-19082 | 4931 | 5590 | 161 | 820 | 1661 |
| AD-19083 | 4932 | 5591 | 162 | 821 | 3162 |
| AD-19738 | 4933 | 5592 | 163 | 822 | 1906 |
| AD-19739 | 4934 | 5593 | 164 | 823 | 825 |
| AD-19740 | 4935 | 5594 | 165 | 824 | 1838 |
| AD-19741 | 4936 | 5595 | 166 | 825 | 1714 |
| AD-19742 | 4937 | 5596 | 167 | 826 | 1859 |
| AD-19743 | 4938 | 5597 | 168 | 827 | 324 |
| AD-19744 | 4939 | 5598 | 169 | 828 | 535 |
| AD-19745 | 4940 | 5599 | 170 | 829 | 822 |
| AD-19746 | 4941 | 5600 | 171 | 830 | 826 |
| AD-19747 | 4942 | 5601 | 172 | 831 | 851 |
| AD-19748 | 4943 | 5602 | 173 | 832 | 1313 |
| AD-19749 | 4944 | 5603 | 174 | 833 | 1860 |
| AD-19750 | 4945 | 5604 | 175 | 834 | 2016 |
| AD-19751 | 4946 | 5605 | 176 | 835 | 1868 |
| AD-19752 | 4947 | 5606 | 177 | 836 | 1869 |
| AD-19753 | 4948 | 5607 | 178 | 837 | 1876 |
| AD-19754 | 4949 | 5608 | 179 | 838 | 1908 |
| AD-19755 | 4950 | 5609 | 180 | 839 | 2192 |
| AD-19756 | 4951 | 5610 | 181 | 840 | 520 |
| AD-19757 | 4952 | 5611 | 182 | 841 | 524 |
| AD-19758 | 4953 | 5612 | 183 | 842 | 623 |
| AD-19759 | 4954 | 5613 | 184 | 843 | 916 |
| AD-19760 | 4955 | 5614 | 185 | 844 | 1153 |
| AD-19761 | 4956 | 5615 | 186 | 845 | 1677 |
| AD-19762 | 4957 | 5616 | 187 | 846 | 1864 |
| AD-19763 | 4958 | 5617 | 188 | 847 | 246 |
| AD-19765 | 4959 | 5618 | 189 | 848 | 637 |
| AD-19766 | 4960 | 5619 | 190 | 849 | 823 |
| AD-19767 | 4961 | 5620 | 191 | 850 | 1028 |
| AD-19768 | 4962 | 5621 | 192 | 851 | 1314 |
| AD-20124 | 4963 | 5622 | 193 | 852 | 2012 |
| AD-25889 | 4964 | 5623 | 194 | 853 | 2632 |
| AD-25890 | 4965 | 5624 | 195 | 854 | 2637 |

TABLE 1-continued

SEQ ID NOs. for RNAi Agents to Beta-Catenin
Provided in Table 1 are the nickname of various Beta-Catenin RNAi
duplexes; the unmodified sense and anti-sense sequences and SEQ ID NOs;
an example modified sense and antisense sequence and SEQ ID NOs;
and the position of the RNAi agent within the Beta-Catenin gene.

| | UNMODIFIED SEQUENCE | | EXAMPLE MODIFIED SEQUENCE | | |
|---|---|---|---|---|---|
| DUPLEX | Sense SEQ ID NO: | Anti-sense SEQ ID NO: | Sense SEQ ID NO: | Anti-sense SEQ ID NO: | Position |
| AD-25891 | 4966 | 5625 | 196 | 855 | 2648 |
| AD-25892 | 4967 | 5626 | 197 | 856 | 2649 |
| AD-25893 | 4968 | 5627 | 198 | 857 | 2663 |
| AD-25894 | 4969 | 5628 | 199 | 858 | 2664 |
| AD-25895 | 4970 | 5629 | 200 | 859 | 2694 |
| AD-25896 | 4971 | 5630 | 201 | 860 | 2695 |
| AD-25897 | 4972 | 5631 | 202 | 861 | 2697 |
| AD-25898 | 4973 | 5632 | 203 | 862 | 2698 |
| AD-25899 | 4974 | 5633 | 204 | 863 | 2699 |
| AD-25900 | 4975 | 5634 | 205 | 864 | 2751 |
| AD-25901 | 4976 | 5635 | 206 | 865 | 2752 |
| AD-25902 | 4977 | 5636 | 207 | 866 | 2753 |
| AD-25903 | 4978 | 5637 | 208 | 867 | 2832 |
| AD-25904 | 4979 | 5638 | 209 | 868 | 2833 |
| AD-25905 | 4980 | 5639 | 210 | 869 | 2837 |
| AD-25906 | 4981 | 5640 | 211 | 870 | 2843 |
| AD-25907 | 4982 | 5641 | 212 | 871 | 2844 |
| AD-25908 | 4983 | 5642 | 213 | 872 | 2845 |
| AD-25909 | 4984 | 5643 | 214 | 873 | 2846 |
| AD-25910 | 4885 | 5644 | 215 | 874 | 2859 |
| AD-25911 | 4986 | 5645 | 216 | 875 | 2913 |
| AD-25912 | 4987 | 5646 | 217 | 876 | 2914 |
| AD-25913 | 4988 | 5647 | 218 | 877 | 2938 |
| AD-25914 | 4989 | 5648 | 219 | 878 | 2940 |
| AD-25915 | 4990 | 5649 | 220 | 879 | 2941 |
| AD-25916 | 4991 | 5650 | 221 | 880 | 2942 |
| AD-25917 | 4992 | 5651 | 222 | 881 | 2991 |
| AD-25918 | 4993 | 5652 | 223 | 882 | 2992 |
| AD-25919 | 4994 | 5653 | 224 | 883 | 2997 |
| AD-25920 | 4995 | 5654 | 225 | 884 | 2998 |
| AD-25921 | 4996 | 5655 | 226 | 885 | 3077 |
| AD-25922 | 4997 | 5656 | 227 | 886 | 3078 |
| AD-25923 | 4998 | 5657 | 228 | 887 | 3080 |
| AD-25924 | 4999 | 5658 | 229 | 888 | 3083 |
| AD-25925 | 5000 | 5659 | 230 | 889 | 3110 |
| AD-25926 | 5001 | 5660 | 231 | 890 | 3111 |
| AD-25927 | 5002 | 5661 | 232 | 891 | 3112 |
| AD-25928 | 5003 | 5662 | 233 | 892 | 3123 |
| AD-25929 | 5004 | 5663 | 234 | 893 | 3124 |
| AD-25930 | 5005 | 5664 | 235 | 894 | 3125 |
| AD-25931 | 5006 | 5665 | 236 | 895 | 3132 |
| AD-25932 | 5007 | 5666 | 237 | 896 | 3133 |
| AD-25933 | 5008 | 5667 | 238 | 897 | 3135 |
| AD-25934 | 5009 | 5668 | 239 | 898 | 3168 |
| AD-25935 | 5010 | 5669 | 240 | 899 | 3169 |
| AD-25936 | 5011 | 5670 | 241 | 900 | 3172 |
| AD-25937 | 5012 | 5671 | 242 | 901 | 3192 |
| AD-25938 | 5013 | 5672 | 243 | 902 | 2665 |
| AD-25939 | 5014 | 5673 | 244 | 903 | 2682 |
| AD-25940 | 5015 | 5674 | 245 | 904 | 2683 |
| AD-25941 | 5016 | 5675 | 246 | 905 | 2684 |
| AD-25942 | 5017 | 5676 | 247 | 906 | 2685 |
| AD-25943 | 5018 | 5677 | 248 | 907 | 2686 |
| AD-25944 | 5019 | 5678 | 249 | 908 | 2687 |
| AD-25945 | 5020 | 5679 | 250 | 909 | 2696 |
| AD-25946 | 5021 | 5680 | 251 | 910 | 2709 |
| AD-25947 | 5022 | 5681 | 252 | 911 | 2710 |
| AD-25948 | 5023 | 5682 | 253 | 912 | 2711 |
| AD-25949 | 5024 | 5683 | 254 | 913 | 2712 |
| AD-25950 | 5025 | 5684 | 255 | 914 | 2713 |
| AD-25951 | 5026 | 5685 | 256 | 915 | 2714 |
| AD-25952 | 5027 | 5686 | 257 | 916 | 2834 |
| AD-25953 | 5028 | 5687 | 258 | 917 | 2835 |
| AD-25954 | 5029 | 5688 | 259 | 918 | 2836 |
| AD-25955 | 5030 | 5689 | 260 | 919 | 2842 |
| AD-25956 | 5031 | 5690 | 261 | 920 | 2847 |
| AD-25957 | 5032 | 5691 | 262 | 921 | 2848 |
| AD-25958 | 5033 | 5692 | 263 | 922 | 2871 |
| AD-25959 | 5034 | 5693 | 264 | 923 | 2993 |
| AD-25960 | 5035 | 5694 | 265 | 924 | 2996 |
| AD-25961 | 5036 | 5695 | 266 | 925 | 3079 |
| AD-25962 | 5037 | 5696 | 267 | 926 | 3084 |
| AD-25963 | 5038 | 5697 | 268 | 927 | 3092 |
| AD-25964 | 5039 | 5698 | 269 | 928 | 3109 |
| AD-26017 | 5040 | 5699 | 270 | 929 | 3152 |
| AD-26018 | 5041 | 5700 | 271 | 930 | 3170 |
| AD-26019 | 5042 | 5701 | 272 | 931 | 3171 |
| AD-26020 | 5043 | 5702 | 273 | 932 | 3198 |
| AD-26021 | 5044 | 5703 | 274 | 933 | 3199 |
| AD-26022 | 5045 | 5704 | 275 | 934 | 207 |
| AD-26023 | 5046 | 5705 | 276 | 935 | 208 |
| AD-26024 | 5047 | 5706 | 277 | 936 | 215 |
| AD-26025 | 5048 | 5707 | 278 | 937 | 216 |
| AD-26026 | 5049 | 5708 | 279 | 938 | 217 |
| AD-26027 | 5050 | 5709 | 280 | 939 | 221 |
| AD-26028 | 5051 | 5710 | 281 | 940 | 222 |
| AD-26029 | 5052 | 5711 | 282 | 941 | 225 |
| AD-26030 | 5053 | 5712 | 283 | 942 | 230 |
| AD-26031 | 5054 | 5713 | 284 | 943 | 231 |
| AD-26032 | 5055 | 5714 | 285 | 944 | 232 |
| AD-26033 | 5056 | 5715 | 286 | 945 | 235 |
| AD-26034 | 5057 | 5716 | 287 | 946 | 236 |
| AD-26035 | 5058 | 5717 | 288 | 947 | 251 |
| AD-26036 | 5059 | 5718 | 289 | 948 | 252 |
| AD-26037 | 5060 | 5719 | 290 | 949 | 257 |
| AD-26038 | 5061 | 5720 | 291 | 950 | 262 |
| AD-26039 | 5062 | 5721 | 292 | 951 | 268 |
| AD-26040 | 5063 | 5722 | 293 | 952 | 269 |
| AD-26041 | 5064 | 5723 | 294 | 953 | 270 |
| AD-26042 | 5065 | 5724 | 295 | 954 | 273 |
| AD-26043 | 5066 | 5725 | 296 | 955 | 285 |
| AD-26044 | 5067 | 5726 | 297 | 956 | 291 |
| AD-26045 | 5068 | 5727 | 298 | 957 | 295 |
| AD-26046 | 5069 | 5728 | 299 | 958 | 305 |
| AD-26047 | 5070 | 5729 | 300 | 959 | 307 |
| AD-26048 | 5071 | 5730 | 301 | 960 | 111 |
| AD-26049 | 5072 | 5731 | 302 | 961 | 316 |
| AD-26050 | 5073 | 5732 | 303 | 962 | 317 |
| AD-26051 | 5074 | 5733 | 304 | 963 | 331 |
| AD-26052 | 5075 | 5734 | 305 | 964 | 338 |
| AD-26053 | 5076 | 5735 | 306 | 965 | 339 |
| AD-26054 | 5077 | 5736 | 307 | 966 | 353 |
| AD-26055 | 5078 | 5737 | 308 | 967 | 354 |
| AD-26056 | 5079 | 5738 | 309 | 968 | 358 |
| AD-26057 | 5080 | 5739 | 310 | 969 | 1216 |
| AD-26058 | 5081 | 5740 | 311 | 970 | 383 |
| AD-26059 | 5082 | 5741 | 312 | 971 | 397 |
| AD-26060 | 5083 | 5742 | 313 | 972 | 402 |
| AD-26061 | 5084 | 5743 | 314 | 973 | 412 |
| AD-26062 | 5085 | 5744 | 315 | 974 | 418 |
| AD-26063 | 5086 | 5745 | 316 | 975 | 424 |
| AD-26064 | 5087 | 5746 | 317 | 976 | 441 |
| AD-26065 | 5088 | 5747 | 318 | 977 | 442 |
| AD-26066 | 5089 | 5748 | 319 | 978 | 451 |
| AD-26067 | 5090 | 5749 | 320 | 979 | 458 |
| AD-26068 | 5091 | 5750 | 321 | 980 | 1232 |
| AD-26069 | 5092 | 5751 | 322 | 981 | 1233 |
| AD-26070 | 5093 | 5752 | 323 | 982 | 460 |
| AD-26071 | 5094 | 5753 | 324 | 983 | 461 |
| AD-26072 | 5095 | 5754 | 325 | 984 | 471 |
| AD-26073 | 5096 | 5755 | 326 | 985 | 478 |
| AD-26074 | 5097 | 5756 | 327 | 986 | 481 |
| AD-26075 | 5098 | 5757 | 328 | 987 | 487 |
| AD-26076 | 5099 | 5758 | 329 | 988 | 493 |

TABLE 1-continued

SEQ ID NOs. for RNAi Agents to Beta-Catenin
Provided in Table 1 are the nickname of various Beta-Catenin RNAi duplexes; the unmodified sense and anti-sense sequences and SEQ ID NOs; an example modified sense and antisense sequence and SEQ ID NOs; and the position of the RNAi agent within the Beta-Catenin gene.

| DUPLEX | UNMODIFIED SEQUENCE Sense SEQ ID NO: | UNMODIFIED SEQUENCE Anti-sense SEQ ID NO: | EXAMPLE MODIFIED SEQUENCE Sense SEQ ID NO: | EXAMPLE MODIFIED SEQUENCE Anti-sense SEQ NO: | Position |
|---|---|---|---|---|---|
| AD-26077 | 5100 | 5759 | 330 | 989 | 507 |
| AD-26078 | 5101 | 5760 | 331 | 990 | 512 |
| AD-26079 | 5102 | 5761 | 332 | 991 | 532 |
| AD-26080 | 5103 | 5762 | 333 | 992 | 542 |
| AD-26081 | 5104 | 5763 | 334 | 993 | 543 |
| AD-26082 | 5105 | 5764 | 335 | 994 | 546 |
| AD-26083 | 5106 | 5765 | 336 | 995 | 558 |
| AD-26084 | 5107 | 5766 | 337 | 996 | 559 |
| AD-26085 | 5108 | 5767 | 338 | 997 | 562 |
| AD-26086 | 5109 | 5768 | 339 | 998 | 576 |
| AD-26087 | 5110 | 5769 | 340 | 999 | 581 |
| AD-26088 | 5111 | 5770 | 341 | 1000 | 584 |
| AD-26089 | 5112 | 5771 | 342 | 1001 | 591 |
| AD-26090 | 5113 | 5772 | 343 | 1002 | 595 |
| AD-26091 | 5114 | 5773 | 344 | 1003 | 604 |
| AD-26092 | 5115 | 5774 | 345 | 1004 | 611 |
| AD-26093 | 5116 | 5775 | 346 | 1005 | 612 |
| AD-26094 | 5117 | 5776 | 347 | 1006 | 613 |
| AD-26095 | 5118 | 5777 | 348 | 1007 | 623 |
| AD-26096 | 5119 | 5778 | 349 | 1008 | 635 |
| AD-26097 | 5120 | 5779 | 350 | 1009 | 642 |
| AD-26098 | 5121 | 5780 | 351 | 1010 | 648 |
| AD-26099 | 5122 | 5781 | 352 | 1011 | 649 |
| AD-26100 | 5123 | 5782 | 353 | 1012 | 652 |
| AD-26101 | 5124 | 5783 | 354 | 1013 | 658 |
| AD-26102 | 5125 | 5784 | 355 | 1014 | 662 |
| AD-26103 | 5126 | 5785 | 356 | 1015 | 666 |
| AD-26104 | 5127 | 5786 | 357 | 1016 | 669 |
| AD-26105 | 5128 | 5787 | 358 | 1017 | 670 |
| AD-26106 | 5129 | 5788 | 359 | 1018 | 672 |
| AD-26107 | 5130 | 5789 | 360 | 1019 | 682 |
| AD-26108 | 5131 | 5790 | 361 | 1020 | 685 |
| AD-26109 | 5132 | 5791 | 362 | 1021 | 691 |
| AD-26110 | 5133 | 5792 | 363 | 1022 | 707 |
| AD-26111 | 5134 | 5793 | 364 | 1023 | 708 |
| AD-26112 | 5135 | 5794 | 365 | 1024 | 715 |
| AD-26123 | 5136 | 5795 | 366 | 1025 | 722 |
| AD-26124 | 5137 | 5796 | 367 | 1026 | 723 |
| AD-26125 | 5138 | 5797 | 368 | 1027 | 724 |
| AD-26126 | 5139 | 5798 | 369 | 1028 | 730 |
| AD-26127 | 5140 | 5799 | 370 | 1029 | 731 |
| AD-26128 | 5141 | 5800 | 371 | 1030 | 732 |
| AD-26129 | 5142 | 5801 | 372 | 1031 | 733 |
| AD-26130 | 5143 | 5802 | 373 | 1032 | 755 |
| AD-26131 | 5144 | 5803 | 374 | 1033 | 756 |
| AD-26132 | 5145 | 5804 | 375 | 1034 | 757 |
| AD-26133 | 5146 | 5805 | 376 | 1035 | 758 |
| AD-26134 | 5147 | 5806 | 377 | 1036 | 1548 |
| AD-26135 | 5148 | 5807 | 378 | 1037 | 1551 |
| AD-26136 | 5149 | 5808 | 379 | 1038 | 759 |
| AD-26137 | 5150 | 5809 | 380 | 1039 | 778 |
| AD-26138 | 5151 | 5810 | 381 | 1040 | 785 |
| AD-26139 | 5152 | 5811 | 382 | 1041 | 788 |
| AD-26140 | 5153 | 5812 | 383 | 1042 | 789 |
| AD-26141 | 5154 | 5813 | 384 | 1043 | 1624 |
| AD-26142 | 5155 | 5814 | 385 | 1044 | 790 |
| AD-26143 | 5156 | 5815 | 386 | 1045 | 791 |
| AD-26144 | 5157 | 5816 | 387 | 1046 | 812 |
| AD-26145 | 5158 | 5817 | 388 | 1047 | 813 |
| AD-26146 | 5159 | 5818 | 389 | 1048 | 816 |
| AD-26147 | 5160 | 5819 | 390 | 1049 | 821 |
| AD-26148 | 5161 | 5820 | 391 | 1050 | 831 |
| AD-26149 | 5162 | 5821 | 392 | 1051 | 842 |
| AD-26150 | 5163 | 5822 | 393 | 1052 | 843 |
| AD-26151 | 5164 | 5823 | 394 | 1053 | 851 |
| AD-26152 | 5165 | 5824 | 395 | 1054 | 855 |
| AD-26153 | 5166 | 5825 | 396 | 1055 | 861 |
| AD-26154 | 5167 | 5826 | 397 | 1056 | 862 |
| AD-26155 | 5168 | 5827 | 398 | 1057 | 866 |
| AD-26156 | 5169 | 5828 | 399 | 1058 | 871 |
| AD-26157 | 5170 | 5829 | 400 | 1059 | 874 |
| AD-26158 | 5171 | 5830 | 401 | 1060 | 877 |
| AD-26159 | 5172 | 5831 | 402 | 1061 | 887 |
| AD-26160 | 5173 | 5832 | 403 | 1062 | 903 |
| AD-26161 | 5174 | 5833 | 404 | 1063 | 907 |
| AD-26162 | 5175 | 5834 | 405 | 1064 | 909 |
| AD-26163 | 5176 | 5835 | 406 | 1065 | 913 |
| AD-26164 | 5177 | 5836 | 407 | 1066 | 914 |
| AD-26165 | 5178 | 5837 | 408 | 1067 | 919 |
| AD-26166 | 5179 | 5838 | 409 | 1068 | 960 |
| AD-26167 | 5180 | 5839 | 410 | 1069 | 975 |
| AD-26168 | 5181 | 5840 | 411 | 1070 | 976 |
| AD-26169 | 5182 | 5841 | 412 | 1071 | 977 |
| AD-26170 | 5183 | 5842 | 413 | 1072 | 978 |
| AD-26171 | 5184 | 5843 | 414 | 1073 | 982 |
| AD-26172 | 5185 | 5844 | 415 | 1074 | 986 |
| AD-26173 | 5186 | 5845 | 416 | 1075 | 997 |
| AD-26174 | 5187 | 5846 | 417 | 1076 | 998 |
| AD-26175 | 5188 | 5847 | 418 | 1077 | 1848 |
| AD-26176 | 5189 | 5848 | 419 | 1078 | 1849 |
| AD-26177 | 5190 | 5849 | 420 | 1079 | 1005 |
| AD-26178 | 5191 | 5850 | 421 | 1080 | 1008 |
| AD-26179 | 5192 | 5851 | 422 | 1081 | 1009 |
| AD-26180 | 5193 | 5852 | 423 | 1082 | 1010 |
| AD-26181 | 5194 | 5853 | 424 | 1083 | 1011 |
| AD-26182 | 5195 | 5854 | 425 | 1084 | 1012 |
| AD-26183 | 5196 | 5855 | 426 | 1085 | 1018 |
| AD-26184 | 5197 | 5856 | 427 | 1086 | 1927 |
| AD-26185 | 5198 | 5857 | 428 | 1087 | 1019 |
| AD-26186 | 5199 | 5858 | 6495 | 1088 | 1022 |
| AD-26187 | 5200 | 5859 | 6496 | 1089 | 1032 |
| AD-26188 | 5201 | 5860 | 431 | 1090 | 1036 |
| AD-26189 | 5202 | 5861 | 432 | 1091 | 1037 |
| AD-26190 | 5203 | 5862 | 433 | 1092 | 1038 |
| AD-26191 | 5204 | 5863 | 434 | 1093 | 1039 |
| AD-26192 | 5205 | 5864 | 435 | 1094 | 1040 |
| AD-26193 | 5206 | 5865 | 436 | 1095 | 1041 |
| AD-26194 | 5207 | 5866 | 437 | 1096 | 1042 |
| AD-26195 | 5208 | 5867 | 438 | 1097 | 1048 |
| AD-26196 | 5209 | 5868 | 439 | 1098 | 1051 |
| AD-26197 | 5210 | 5869 | 440 | 1099 | 1058 |
| AD-26198 | 5211 | 5870 | 441 | 1100 | 1059 |
| AD-26199 | 5212 | 5871 | 442 | 1101 | 1061 |
| AD-26200 | 5213 | 5872 | 443 | 1102 | 1062 |
| AD-26201 | 5214 | 5873 | 444 | 1103 | 1073 |
| AD-26202 | 5215 | 5874 | 445 | 1104 | 1075 |
| AD-26203 | 5216 | 5875 | 446 | 1105 | 1110 |
| AD-26204 | 5217 | 5876 | 447 | 1106 | 206 |
| AD-26205 | 5218 | 5877 | 448 | 1107 | 1113 |
| AD-26206 | 5219 | 5878 | 449 | 1108 | 1114 |
| AD-26207 | 5220 | 5879 | 450 | 1109 | 1115 |
| AD-26208 | 5221 | 5880 | 451 | 1110 | 1118 |
| AD-26209 | 5222 | 5881 | 452 | 1111 | 1119 |
| AD-26210 | 5223 | 5882 | 453 | 1112 | 1139 |
| AD-26211 | 5224 | 5883 | 454 | 1113 | 1153 |
| AD-26212 | 5225 | 5884 | 455 | 1114 | 1185 |
| AD-26213 | 5226 | 5885 | 456 | 1115 | 1220 |
| AD-26214 | 5227 | 5886 | 457 | 1116 | 1221 |
| AD-26215 | 5228 | 5887 | 458 | 1117 | 1222 |
| AD-26216 | 5229 | 5888 | 459 | 1118 | 1225 |
| AD-26217 | 5230 | 5889 | 460 | 1119 | 1226 |
| AD-26218 | 5231 | 5890 | 461 | 1120 | 1227 |
| AD-26651 | 5232 | 5891 | 462 | 1121 | 1228 |
| AD-26652 | 5233 | 5892 | 463 | 1122 | 1229 |

TABLE 1-continued

SEQ ID NOs. for RNAi Agents to Beta-Catenin
Provided in Table 1 are the nickname of various Beta-Catenin RNAi
duplexes; the unmodified sense and anti-sense sequences and SEQ ID NOs;
an example modified sense and antisense sequence and SEQ ID NOs;
and the position of the RNAi agent within the Beta-Catenin gene.

| DUPLEX | UNMODIFIED SEQUENCE | | EXAMPLE MODIFIED SEQUENCE | | Position |
|---|---|---|---|---|---|
| | Sense SEQ ID NO: | Anti-sense SEQ ID NO: | Sense SEQ ID NO: | Anti-sense SEQ ID NO: | |
| AD-26653 | 5234 | 5893 | 464 | 1123 | 1230 |
| AD-26654 | 5235 | 5894 | 465 | 1124 | 1231 |
| AD-26655 | 5236 | 5895 | 466 | 1125 | 1242 |
| AD-26656 | 5237 | 5896 | 467 | 1126 | 1243 |
| AD-26657 | 5238 | 5897 | 468 | 1127 | 1244 |
| AD-26658 | 5239 | 5898 | 469 | 1128 | 1247 |
| AD-26659 | 5240 | 5899 | 470 | 1129 | 1271 |
| AD-26660 | 5241 | 5900 | 471 | 1130 | 1284 |
| AD-26661 | 5242 | 5901 | 472 | 1131 | 1291 |
| AD-26662 | 5243 | 5902 | 473 | 1132 | 1292 |
| AD-26663 | 5244 | 5903 | 474 | 1133 | 1337 |
| AD-26664 | 5245 | 5904 | 475 | 1134 | 1338 |
| AD-26665 | 5246 | 5905 | 476 | 1135 | 1346 |
| AD-26666 | 5247 | 5906 | 477 | 1136 | 1347 |
| AD-26667 | 5248 | 5907 | 478 | 1137 | 1366 |
| AD-26668 | 5249 | 5908 | 479 | 1138 | 1370 |
| AD-26669 | 5250 | 5909 | 480 | 1139 | 1375 |
| AD-26670 | 5251 | 5910 | 481 | 1140 | 1381 |
| AD-26671 | 5252 | 5911 | 482 | 1141 | 1384 |
| AD-26672 | 5253 | 5912 | 483 | 1142 | 1396 |
| AD-26673 | 5254 | 5913 | 484 | 1143 | 1397 |
| AD-26674 | 5255 | 5914 | 485 | 1144 | 1410 |
| AD-26675 | 5256 | 5915 | 486 | 1145 | 1411 |
| AD-26676 | 5257 | 5916 | 487 | 1146 | 1414 |
| AD-26677 | 5258 | 5917 | 488 | 1147 | 2371 |
| AD-26678 | 5259 | 5918 | 489 | 1148 | 1415 |
| AD-26679 | 5260 | 5919 | 490 | 1149 | 1420 |
| AD-26680 | 5261 | 5920 | 491 | 1150 | 1427 |
| AD-26681 | 5262 | 5921 | 492 | 1151 | 1430 |
| AD-26682 | 5263 | 5922 | 493 | 1152 | 1432 |
| AD-26683 | 5264 | 5923 | 494 | 1153 | 1438 |
| AD-26684 | 5265 | 5924 | 495 | 1154 | 1447 |
| AD-26685 | 5266 | 5925 | 496 | 1155 | 1456 |
| AD-26686 | 5267 | 5926 | 497 | 1156 | 1465 |
| AD-26687 | 5268 | 5927 | 498 | 1157 | 1468 |
| AD-26688 | 5269 | 5928 | 499 | 1158 | 1474 |
| AD-26689 | 5270 | 5929 | 500 | 1159 | 1481 |
| AD-26690 | 5271 | 5930 | 501 | 1160 | 1486 |
| AD-26691 | 5272 | 5931 | 502 | 1161 | 1489 |
| AD-26692 | 5273 | 5932 | 503 | 1162 | 1490 |
| AD-26693 | 5274 | 5933 | 504 | 1163 | 2441 |
| AD-26694 | 5275 | 5934 | 505 | 1164 | 1491 |
| AD-26695 | 5276 | 5935 | 506 | 1165 | 1493 |
| AD-26696 | 5277 | 5936 | 507 | 1166 | 1494 |
| AD-26697 | 5278 | 5937 | 508 | 1167 | 1517 |
| AD-26698 | 5279 | 5938 | 509 | 1168 | 1518 |
| AD-26699 | 5280 | 5939 | 510 | 1169 | 1519 |
| AD-26700 | 5281 | 5940 | 511 | 1170 | 1522 |
| AD-26701 | 5282 | 5941 | 512 | 1171 | 1523 |
| AD-26702 | 5283 | 5942 | 513 | 1172 | 1526 |
| AD-26703 | 5284 | 5943 | 514 | 1173 | 1527 |
| AD-26704 | 5285 | 5944 | 515 | 1174 | 1539 |
| AD-26705 | 5286 | 5945 | 516 | 1175 | 1540 |
| AD-26706 | 5287 | 5946 | 517 | 1176 | 1545 |
| AD-26707 | 5288 | 5947 | 518 | 1177 | 1546 |
| AD-26708 | 5289 | 5948 | 519 | 1178 | 1547 |
| AD-26709 | 5290 | 5949 | 520 | 1179 | 1580 |
| AD-26710 | 5291 | 5950 | 521 | 1180 | 1581 |
| AD-26711 | 5292 | 5951 | 522 | 1181 | 1591 |
| AD-26712 | 5293 | 5952 | 523 | 1182 | 1598 |
| AD-26713 | 5294 | 5953 | 524 | 1183 | 1606 |
| AD-26714 | 5295 | 5954 | 525 | 1184 | 1629 |
| AD-26715 | 5296 | 5955 | 526 | 1185 | 1644 |
| AD-26716 | 5297 | 5956 | 527 | 1186 | 1654 |
| AD-26717 | 5298 | 5957 | 528 | 1187 | 1678 |
| AD-26718 | 5299 | 5958 | 529 | 1188 | 1681 |
| AD-26719 | 5300 | 5959 | 530 | 1189 | 1689 |
| AD-26720 | 5301 | 5960 | 531 | 1190 | 1699 |
| AD-26721 | 5302 | 5961 | 532 | 1191 | 1705 |
| AD-26722 | 5303 | 5962 | 533 | 1192 | 1711 |
| AD-26723 | 5304 | 5963 | 534 | 1193 | 1716 |
| AD-26724 | 5305 | 5964 | 535 | 1194 | 1717 |
| AD-26725 | 5306 | 5965 | 536 | 1195 | 1723 |
| AD-26726 | 5307 | 5966 | 537 | 1196 | 1729 |
| AD-26727 | 5308 | 5967 | 538 | 1197 | 1735 |
| AD-26728 | 5309 | 5968 | 539 | 1198 | 1736 |
| AD-26729 | 5310 | 5969 | 540 | 1199 | 1737 |
| AD-26730 | 5311 | 5970 | 541 | 1200 | 1743 |
| AD-26731 | 5312 | 5971 | 542 | 1201 | 1744 |
| AD-26732 | 5313 | 5972 | 543 | 1202 | 1754 |
| AD-26733 | 5314 | 5973 | 544 | 1203 | 1770 |
| AD-26734 | 5315 | 5974 | 545 | 1204 | 1771 |
| AD-26735 | 5316 | 5975 | 546 | 1205 | 1772 |
| AD-26736 | 5317 | 5976 | 547 | 1206 | 1778 |
| AD-26737 | 5318 | 5977 | 548 | 1207 | 1783 |
| AD-26738 | 5319 | 5978 | 549 | 1208 | 1787 |
| AD-26739 | 5320 | 5979 | 550 | 1209 | 1792 |
| AD-26740 | 5321 | 5980 | 551 | 1210 | 1798 |
| AD-26741 | 5322 | 5981 | 552 | 1211 | 1861 |
| AD-26742 | 5323 | 5982 | 553 | 1212 | 1866 |
| AD-26743 | 5324 | 5983 | 554 | 1213 | 1870 |
| AD-26744 | 5325 | 5984 | 555 | 1214 | 1873 |
| AD-26745 | 5326 | 5985 | 556 | 1215 | 1882 |
| AD-26746 | 5327 | 5986 | 557 | 1216 | 1888 |
| AD-26747 | 5328 | 5987 | 558 | 1217 | 1889 |
| AD-26748 | 5329 | 5988 | 559 | 1218 | 1928 |
| AD-26749 | 5330 | 5989 | 560 | 1219 | 1929 |
| AD-26750 | 5331 | 5990 | 561 | 1220 | 1930 |
| AD-26751 | 5332 | 5991 | 562 | 1221 | 1955 |
| AD-26752 | 5333 | 5992 | 563 | 1222 | 1956 |
| AD-26753 | 5334 | 5993 | 564 | 1223 | 1999 |
| AD-26754 | 5335 | 5994 | 565 | 1224 | 2002 |
| AD-26755 | 5336 | 5995 | 566 | 1225 | 2007 |
| AD-26756 | 5337 | 5996 | 567 | 1226 | 2013 |
| AD-26757 | 5338 | 5997 | 568 | 1227 | 2014 |
| AD-26758 | 5339 | 5998 | 569 | 1228 | 2038 |
| AD-26759 | 5340 | 5999 | 570 | 1229 | 2042 |
| AD-26760 | 5341 | 6000 | 571 | 1230 | 2046 |
| AD-26761 | 5342 | 6001 | 572 | 1231 | 2047 |
| AD-26762 | 5343 | 6002 | 573 | 1232 | 2059 |
| AD-26763 | 5344 | 6003 | 574 | 1233 | 2060 |
| AD-26764 | 5345 | 6004 | 575 | 1234 | 2061 |
| AD-26765 | 5346 | 6005 | 576 | 1235 | 2062 |
| AD-26766 | 5347 | 6006 | 577 | 1236 | 2063 |
| AD-26767 | 5348 | 6007 | 578 | 1237 | 2070 |
| AD-26768 | 5349 | 6008 | 579 | 1238 | 2071 |
| AD-26769 | 5350 | 6009 | 580 | 1239 | 2076 |
| AD-26770 | 5351 | 6010 | 581 | 1240 | 2079 |
| AD-26771 | 5352 | 6011 | 582 | 1241 | 2083 |
| AD-26772 | 5353 | 6012 | 583 | 1242 | 2110 |
| AD-26773 | 5354 | 6013 | 584 | 1243 | 2128 |
| AD-26774 | 5355 | 6014 | 585 | 1244 | 2178 |
| AD-26775 | 5356 | 6015 | 586 | 1245 | 2179 |
| AD-26776 | 5357 | 6016 | 587 | 1246 | 2182 |
| AD-26777 | 5358 | 6017 | 588 | 1247 | 2189 |
| AD-26778 | 5359 | 6018 | 589 | 1248 | 2193 |
| AD-26779 | 5360 | 6019 | 590 | 1249 | 2194 |
| AD-26780 | 5361 | 6020 | 591 | 1250 | 2197 |
| AD-26781 | 5362 | 6021 | 592 | 1251 | 2234 |
| AD-26782 | 5363 | 6022 | 593 | 1252 | 2235 |
| AD-26783 | 5364 | 6023 | 594 | 1253 | 2254 |
| AD-26784 | 5365 | 6024 | 595 | 1254 | 2257 |
| AD-26785 | 5366 | 6025 | 596 | 1255 | 2262 |
| AD-26786 | 5367 | 6026 | 597 | 1256 | 2265 |

TABLE 1-continued

SEQ ID NOs. for RNAi Agents to Beta-Catenin
Provided in Table 1 are the nickname of various Beta-Catenin RNAi
duplexes; the unmodified sense and anti-sense sequences and SEQ ID NOs;
an example modified sense and antisense sequence and SEQ ID NOs;
and the position of the RNAi agent within the Beta-Catenin gene.

| DUPLEX | UNMODIFIED SEQUENCE | | EXAMPLE MODIFIED SEQUENCE | | Position |
|---|---|---|---|---|---|
| | Sense SEQ ID NO: | Anti-sense SEQ ID NO: | Sense SEQ ID NO: | Anti-sense SEQ ID NO: | |
| AD-26787 | 5368 | 6027 | 598 | 1257 | 2272 |
| AD-26788 | 5369 | 6028 | 599 | 1258 | 2278 |
| AD-26789 | 5370 | 6029 | 600 | 1259 | 2298 |
| AD-26790 | 5371 | 6030 | 601 | 1260 | 2303 |
| AD-26791 | 5372 | 6031 | 602 | 1261 | 2365 |
| AD-26792 | 5373 | 6032 | 603 | 1262 | 2375 |
| AD-26793 | 5374 | 6033 | 604 | 1263 | 2376 |
| AD-26794 | 5375 | 6034 | 605 | 1264 | 2386 |
| AD-26795 | 5376 | 6035 | 606 | 1265 | 2393 |
| AD-26796 | 5377 | 6036 | 607 | 1266 | 2397 |
| AD-26797 | 5378 | 6037 | 608 | 1267 | 2398 |
| AD-26798 | 5379 | 6038 | 609 | 1268 | 2402 |
| AD-26799 | 5380 | 6039 | 610 | 1269 | 2406 |
| AD-26800 | 5381 | 6040 | 611 | 1270 | 2407 |
| AD-26801 | 5382 | 6041 | 612 | 1271 | 2420 |
| AD-26802 | 5383 | 6042 | 613 | 1272 | 2421 |
| AD-26803 | 5384 | 6043 | 614 | 1273 | 2422 |
| AD-26804 | 5385 | 6044 | 615 | 1274 | 2431 |
| AD-26805 | 5386 | 6045 | 616 | 1275 | 2436 |
| AD-26806 | 5387 | 6046 | 617 | 1276 | 2451 |
| AD-26807 | 5388 | 6047 | 618 | 1277 | 2454 |
| AD-26808 | 5389 | 6048 | 619 | 1278 | 675 |
| AD-26809 | 5390 | 6049 | 620 | 1279 | 676 |
| AD-26810 | 5391 | 6050 | 621 | 1280 | 679 |
| AD-26811 | 5392 | 6051 | 622 | 1281 | 2458 |
| AD-26812 | 5393 | 6052 | 623 | 1282 | 2461 |
| AD-26813 | 5394 | 6053 | 624 | 1283 | 2466 |
| AD-26814 | 5395 | 6054 | 625 | 1284 | 2493 |
| AD-26815 | 5396 | 6055 | 626 | 1285 | 2494 |
| AD-26816 | 5397 | 6056 | 627 | 1286 | 2503 |
| AD-26817 | 5398 | 6057 | 628 | 1287 | 2515 |
| AD-26818 | 5399 | 6058 | 629 | 1288 | 2542 |
| AD-26819 | 5400 | 6059 | 630 | 1289 | 2580 |
| AD-26820 | 5401 | 6060 | 631 | 1290 | 2581 |
| AD-26821 | 5402 | 6061 | 632 | 1291 | 2595 |
| AD-26822 | 5403 | 6062 | 633 | 1292 | 2601 |
| AD-26823 | 5404 | 6063 | 634 | 1293 | 2605 |
| AD-26824 | 5405 | 6064 | 635 | 1294 | 2606 |
| AD-26825 | 5406 | 6065 | 636 | 1295 | 2607 |
| AD-26826 | 5407 | 6066 | 637 | 1296 | 878 |
| AD-26900 | 5408 | 6067 | 638 | 1297 | 2745 |
| AD-26901 | 5409 | 6068 | 639 | 1298 | 2872 |
| AD-26902 | 5410 | 6069 | 640 | 1299 | 2915 |
| AD-26903 | 5411 | 6070 | 641 | 1300 | 2916 |
| AD-26904 | 5412 | 6071 | 642 | 1301 | 2918 |
| AD-26905 | 5413 | 6072 | 643 | 1302 | 2919 |
| AD-26906 | 5414 | 6073 | 644 | 1303 | 2939 |
| AD-26907 | 5415 | 6074 | 645 | 1304 | 2978 |
| AD-26908 | 5416 | 6075 | 646 | 1305 | 2979 |
| AD-26909 | 5417 | 6076 | 647 | 1306 | 2980 |
| AD-26910 | 5418 | 6077 | 648 | 1307 | 2981 |
| AD-26911 | 5419 | 6078 | 649 | 1308 | 2983 |
| AD-26912 | 5420 | 6079 | 650 | 1309 | 2984 |
| AD-26913 | 5421 | 6080 | 651 | 1310 | 2986 |
| AD-26914 | 5422 | 6081 | 652 | 1311 | 3081 |
| AD-26915 | 5423 | 6082 | 653 | 1312 | 3082 |
| AD-26916 | 5424 | 6083 | 654 | 1313 | 2917 |
| AD-26917 | 5425 | 6084 | 655 | 1314 | 2994 |
| AD-26918 | 5426 | 6085 | 656 | 1315 | 2995 |
| AD-26919 | 5427 | 6086 | 657 | 1316 | 3134 |
| AD-26920 | 5428 | 6087 | 658 | 1317 | 1535 |
| AD-26921 | 5429 | 6088 | 659 | 1318 | 1801 |
| SET1 1245 | 6090 | 6111 | 6193 | 6361 | 1227 |
| SET1 1245 | 6090 | 6111 | 6214 | 6382 | 1227 |
| SET1 1245 | 6090 | 6111 | 6151 | 6319 | 1227 |
| SET1 1245 | 6090 | 6111 | 6172 | 6340 | 1227 |
| SET1 1249 | 6091 | 6112 | 6199 | 6367 | 1231 |
| SET1 1249 | 6091 | 6112 | 6220 | 6388 | 1231 |
| SET1 1249 | 6091 | 6112 | 6157 | 6325 | 1231 |
| SET1 1249 | 6091 | 6112 | 6178 | 6346 | 1231 |
| SET1 1250 | 6092 | 6113 | 6200 | 6368 | 1232 |
| SET1 1250 | 6092 | 6113 | 6221 | 6389 | 1232 |
| SET1 1250 | 6092 | 6113 | 6158 | 6326 | 1232 |
| SET1 1250 | 6092 | 6113 | 6179 | 6347 | 1232 |
| SET1 1450 | 6093 | 6114 | 6195 | 6363 | 1432 |
| SET1 1450 | 6093 | 6114 | 6216 | 6384 | 1432 |
| SET1 1450 | 6093 | 6114 | 6153 | 6321 | 1432 |
| SET1 1450 | 6093 | 6114 | 6174 | 6342 | 1432 |
| SET1 1545 | 6094 | 6115 | 6202 | 6370 | 1527 |
| SET1 1545 | 6094 | 6115 | 6223 | 6391 | 1527 |
| SET1 1545 | 6094 | 6115 | 6160 | 6328 | 1527 |
| SET1 1545 | 6094 | 6115 | 6181 | 6349 | 1527 |
| SET1 1755 | 6095 | 6116 | 6203 | 6371 | 1737 |
| SET1 1755 | 6095 | 6116 | 6224 | 6392 | 1737 |
| SET1 1755 | 6095 | 6116 | 6161 | 6329 | 1737 |
| SET1 1755 | 6095 | 6116 | 6182 | 6350 | 1737 |
| SET1 1814 | 6096 | 6117 | 6192 | 6360 | 1796 |
| SET1 1814 | 6096 | 6117 | 6213 | 6381 | 1796 |
| SET1 1814 | 6096 | 6117 | 6150 | 6318 | 1796 |
| SET1 1814 | 6096 | 6117 | 6171 | 6339 | 1796 |
| SET1 1816 | 6097 | 6118 | 6187 | 6355 | 1798 |
| SET1 1816 | 6097 | 6118 | 6208 | 6376 | 1798 |
| SET1 1816 | 6097 | 6118 | 6145 | 6313 | 1798 |
| SET1 1816 | 6097 | 6118 | 6166 | 6334 | 1798 |
| SET1 1974 | 6098 | 6119 | 6188 | 6356 | 1956 |
| SET1 1974 | 6098 | 6119 | 6209 | 6377 | 1956 |
| SET1 1974 | 6098 | 6119 | 6146 | 6314 | 1956 |
| SET1 1974 | 6098 | 6119 | 6167 | 6335 | 1956 |
| SET1 2202 | 6099 | 6120 | 6201 | 6369 | 2184 |
| SET1 2202 | 6099 | 6120 | 6222 | 6390 | 2184 |
| SET1 2202 | 6099 | 6120 | 6159 | 6327 | 2184 |
| SET1 2202 | 6099 | 6120 | 6180 | 6348 | 2184 |
| SET1 2425 | 6100 | 6121 | 6189 | 6357 | 2407 |
| SET1 2425 | 6100 | 6121 | 6210 | 6378 | 2407 |
| SET1 2425 | 6100 | 6121 | 6147 | 6315 | 2407 |
| SET1 2425 | 6100 | 6121 | 6168 | 6336 | 2407 |
| SET1 254 | 6101 | 6122 | 6183 | 6351 | 236 |
| SET1 254 | 6101 | 6122 | 6204 | 6372 | 236 |
| SET1 254 | 6101 | 6122 | 6141 | 6309 | 236 |
| SET1 254 | 6101 | 6122 | 6162 | 6330 | 236 |
| SET1 3146 | 6102 | 6123 | 6190 | 6358 | 3128 |
| SET1 3146 | 6102 | 6123 | 6211 | 6379 | 3128 |
| SET1 3146 | 6102 | 6123 | 6148 | 6316 | 3128 |
| SET1 3146 | 6102 | 6123 | 6169 | 6337 | 3128 |
| SET1 3169 | 6103 | 6124 | 6196 | 6364 | 3151 |
| SET1 3169 | 6103 | 6124 | 6217 | 6385 | 3151 |
| SET1 3169 | 6103 | 6124 | 6154 | 6322 | 3151 |
| SET1 3169 | 6103 | 6124 | 6175 | 6343 | 3151 |
| SET1 3196 | 6104 | 6125 | 6194 | 6362 | 3178 |
| SET1 3196 | 6104 | 6125 | 6215 | 6383 | 3178 |
| SET1 3196 | 6104 | 6125 | 6152 | 6320 | 3178 |
| SET1 3196 | 6104 | 6125 | 6173 | 6341 | 3178 |
| SET1 3477 | 6105 | 6126 | 6197 | 6365 | 3459 |
| SET1 3477 | 6105 | 6126 | 6218 | 6386 | 3459 |
| SET1 3477 | 6105 | 6126 | 6155 | 6323 | 3459 |
| SET1 3477 | 6105 | 6126 | 6176 | 6344 | 3459 |
| SET1 703 | 6106 | 6127 | 6184 | 6352 | 685 |
| SET1 703 | 6106 | 6127 | 6205 | 6373 | 685 |
| SET1 703 | 6106 | 6127 | 6142 | 6310 | 685 |
| SET1 703 | 6106 | 6127 | 6163 | 6331 | 685 |
| SET1 709 | 6107 | 6128 | 6185 | 6353 | 691 |
| SET1 709 | 6107 | 6128 | 6206 | 6374 | 691 |
| SET1 709 | 6107 | 6128 | 6143 | 6311 | 691 |
| SET1 709 | 6107 | 6128 | 6164 | 6332 | 691 |

TABLE 1-continued

SEQ ID NOs. for RNAi Agents to Beta-Catenin
Provided in Table 1 are the nickname of various Beta-Catenin RNAi duplexes; the unmodified sense and anti-sense sequences and SEQ ID NOs; an example modified sense and antisense sequence and SEQ ID NOs; and the position of the RNAi agent within the Beta-Catenin gene.

| DUPLEX | UNMODIFIED SEQUENCE | | EXAMPLE MODIFIED SEQUENCE | | Position |
|---|---|---|---|---|---|
| | Sense SEQ ID NO: | Anti-sense SEQ ID NO: | Sense SEQ ID NO: | Anti-sense SEQ ID NO: | |
| SET1 865 | 6108 | 6129 | 6198 | 6366 | 847 |
| SET1 865 | 6108 | 6129 | 6219 | 6387 | 847 |
| SET1 865 | 6108 | 6129 | 6156 | 6324 | 847 |
| SET1 865 | 6108 | 6129 | 6177 | 6345 | 847 |
| SET1 889 | 6109 | 6130 | 6191 | 6359 | 871 |
| SET1 889 | 6109 | 6130 | 6212 | 6380 | 871 |
| SET1 889 | 6109 | 6130 | 6149 | 6317 | 871 |
| SET1 889 | 6109 | 6130 | 6170 | 6338 | 871 |
| SET1 895 | 6110 | 6131 | 6186 | 6354 | 877 |
| SET1 895 | 6110 | 6131 | 6207 | 6375 | 877 |
| SET1 895 | 6110 | 6131 | 6144 | 6312 | 877 |
| SET1 895 | 6110 | 6131 | 6165 | 6333 | 877 |
| SET1 1245 | 6090 | 6111 | 6235 | 6403 | 1227 |
| SET1 1245 | 6090 | 6111 | 6256 | 6424 | 1227 |
| SET1 1245 | 6090 | 6111 | 6277 | 6445 | 1227 |
| SET1 1245 | 6090 | 6111 | 6298 | 6466 | 1227 |
| SET1 1249 | 6091 | 6112 | 6241 | 6409 | 1231 |
| SET1 1249 | 6091 | 6112 | 6262 | 6430 | 1231 |
| SET1 1249 | 6091 | 6112 | 6283 | 6451 | 1231 |
| SET1 1249 | 6091 | 6112 | 6304 | 6472 | 1231 |
| SET1 1250 | 6092 | 6113 | 6242 | 6410 | 1232 |
| SET1 1250 | 6092 | 6113 | 6263 | 6431 | 1232 |
| SET1 1250 | 6092 | 6113 | 6284 | 6452 | 1232 |
| SET1 1250 | 6092 | 6113 | 6305 | 6473 | 1232 |
| SET1 1450 | 6093 | 6114 | 6237 | 6405 | 1432 |
| SET1 1450 | 6093 | 6114 | 6258 | 6426 | 1432 |
| SET1 1450 | 6093 | 6114 | 6279 | 6447 | 1432 |
| SET1 1450 | 6093 | 6114 | 6300 | 6468 | 1432 |
| SET1 1545 | 6094 | 6115 | 6244 | 6412 | 1527 |
| SET1 1545 | 6094 | 6115 | 6265 | 6433 | 1527 |
| SET1 1545 | 6094 | 6115 | 6286 | 6454 | 1527 |
| SET1 1545 | 6094 | 6115 | 6307 | 6475 | 1527 |
| SET1 1755 | 6095 | 6116 | 6245 | 6413 | 1737 |
| SET1 1755 | 6095 | 6116 | 6266 | 6434 | 1737 |
| SET1 1755 | 6095 | 6116 | 6287 | 6455 | 1737 |
| SET1 1755 | 6095 | 6116 | 6308 | 6476 | 1737 |
| SET1 1814 | 6096 | 6117 | 6234 | 6402 | 1796 |
| SET1 1814 | 6096 | 6117 | 6255 | 6423 | 1796 |
| SET1 1814 | 6096 | 6117 | 6276 | 6444 | 1796 |
| SET1 1814 | 6096 | 6117 | 6297 | 6465 | 1796 |
| SET1 1816 | 6097 | 6118 | 6229 | 6397 | 1798 |
| SET1 1816 | 6097 | 6118 | 6250 | 6418 | 1798 |
| SET1 1816 | 6097 | 6118 | 6271 | 6439 | 1798 |
| SET1 1816 | 6097 | 6118 | 6292 | 6460 | 1798 |
| SET1 1974 | 6098 | 6119 | 6230 | 6398 | 1956 |
| SET1 1974 | 6098 | 6119 | 6251 | 6419 | 1956 |
| SET1 1974 | 6098 | 6119 | 6272 | 6440 | 1956 |
| SET1 1974 | 6098 | 6119 | 6293 | 6461 | 1956 |
| SET1 2202 | 6099 | 6120 | 6243 | 6411 | 2184 |
| SET1 2202 | 6099 | 6120 | 6264 | 6432 | 2184 |
| SET1 2202 | 6099 | 6120 | 6285 | 6453 | 2184 |
| SET1 2202 | 6099 | 6120 | 6306 | 6474 | 2184 |
| SET1 2425 | 6100 | 6121 | 6231 | 6399 | 2407 |
| SET1 2425 | 6100 | 6121 | 6252 | 6420 | 2407 |
| SET1 2425 | 6100 | 6121 | 6273 | 6441 | 2407 |
| SET1 2425 | 6100 | 6121 | 6294 | 6462 | 2407 |
| SET1 254 | 6101 | 6122 | 6225 | 6393 | 236 |
| SET1 254 | 6101 | 6122 | 6246 | 6414 | 236 |
| SET1 254 | 6101 | 6122 | 6267 | 6435 | 236 |
| SET1 254 | 6101 | 6122 | 6288 | 6456 | 236 |
| SET1 3146 | 6102 | 6123 | 6232 | 6400 | 3128 |
| SET1 3146 | 6102 | 6123 | 6253 | 6421 | 3128 |
| SET1 3146 | 6102 | 6123 | 6274 | 6442 | 3128 |
| SET1 3146 | 6102 | 6123 | 6295 | 6463 | 3128 |
| SET1 3169 | 6103 | 6124 | 6238 | 6406 | 3151 |
| SET1 3169 | 6103 | 6124 | 6259 | 6427 | 3151 |
| SET1 3169 | 6103 | 6124 | 6280 | 6448 | 3151 |
| SET1 3169 | 6103 | 6124 | 6301 | 6469 | 3151 |
| SET1 3196 | 6104 | 6125 | 6236 | 6404 | 3178 |
| SET1 3196 | 6104 | 6125 | 6257 | 6425 | 3178 |
| SET1 3196 | 6104 | 6125 | 6278 | 6446 | 3178 |
| SET1 3196 | 6104 | 6125 | 6299 | 6467 | 3178 |
| SET1 3477 | 6105 | 6126 | 6239 | 6407 | 3459 |
| SET1 3477 | 6105 | 6126 | 6260 | 6428 | 3459 |
| SET1 3477 | 6105 | 6126 | 6281 | 6449 | 3459 |
| SET1 3477 | 6105 | 6126 | 6302 | 6470 | 3459 |
| SET1 703 | 6106 | 6127 | 6226 | 6394 | 685 |
| SET1 703 | 6106 | 6127 | 6247 | 6415 | 685 |
| SET1 703 | 6106 | 6127 | 6268 | 6436 | 685 |
| SET1 703 | 6106 | 6127 | 6289 | 6457 | 685 |
| SET1 709 | 6107 | 6128 | 6227 | 6395 | 691 |
| SET1 709 | 6107 | 6128 | 6248 | 6416 | 691 |
| SET1 709 | 6107 | 6128 | 6269 | 6437 | 691 |
| SET1 709 | 6107 | 6128 | 6290 | 6458 | 691 |
| SET1 865 | 6108 | 6129 | 6240 | 6408 | 847 |
| SET1 865 | 6108 | 6129 | 6261 | 6429 | 847 |
| SET1 865 | 6108 | 6129 | 6282 | 6450 | 847 |
| SET1 865 | 6108 | 6129 | 6303 | 6471 | 847 |
| SET1 889 | 6109 | 6130 | 6233 | 6401 | 871 |
| SET1 889 | 6109 | 6130 | 6254 | 6422 | 871 |
| SET1 889 | 6109 | 6130 | 6275 | 6443 | 871 |
| SET1 889 | 6109 | 6130 | 6296 | 6464 | 871 |
| SET1 895 | 6110 | 6131 | 6228 | 6396 | 877 |
| SET1 895 | 6110 | 6131 | 6249 | 6417 | 877 |
| SET1 895 | 6110 | 6131 | 6270 | 6438 | 877 |
| SET1 895 | 6110 | 6131 | 6291 | 6459 | 877 |

Various Embodiments of the Present Disclosure

Various RNAi agents to Beta-Catenin are disclosed in Tables 1, 2, 3, 4, 5, 6, 7, 8 and/or 9.

Tables 1, 2 and 3 provide the sequence, SEQ ID NOs and positions of various RNAi agents to Beta-Catenin, including both unmodified sequences and example modified sequences. The sequences in Table 2 are not modified.

Table 3 provides the sequences and SEQ ID NOs for example modified sequences of the sense and anti-sense strands of various RNAi agents to Beta-Catenin. The present disclosure also encompasses unmodified versions of these sequences, and different versions comprising other modifications or patterns of modification (but the same sequence of bases).

In the sequences in Table 3, lower-case letters (e.g., c, u) indicate modified nucleotides while upper case letters (e.g., C, U, A, G) indicate unmodified nucleotides. In Table 3, example modified versions of each of the sequences are shown. However, the present disclosure encompasses unmodified versions of these sequences and other versions which comprise additional or alternative modifications. Thus, for example, AD-18892 can optionally have the unmodified (or "generic") sequence UGGUGCUGAC-UAUCCAGUU (SEQ ID NO: 429) in the sense strand and AACUGGAUAGUCAGCACCA (SEQ ID NO: 430) in the anti-sense strand. The present disclosure also encompasses alternative modified versions of the duplex comprising UGGUGCUGACUAUCCAGUU (SEQ ID NO: 429) in the sense strand and AACUGGAUAGUCAGCACCA (SEQ ID NO: 430) in the anti-sense strand.

In the sequences in Tables 1, 2, 3, 4, 5, 6, 7 and 8, the modified and unmodified sequences can optionally comprise the sequence "dTdT", "dTsdT" or "UU" at the 3' end. Thus, for example, AD-18892 can optionally have the modified sequence uGGuGcuGAcuAuccAGuudTdT (SEQ ID NO: 6136) or uGGuGcuGAcuAuccAGuudTsdT (SEQ ID NO: 6137) in the sense strand; and AACUGGAuAGUcAGcACcAdTdT (SEQ ID NO: 6138) or AACUGGAuAGUcAGcACcAdTsdT (SEQ ID NO: 6139) in the anti-sense strand. As noted in Table 3, below, dT is 2'-deoxy-thymidine-5'-phosphate and sdT is 2'-deoxy Thymidine 5'-phosphorothioate. In the disclosed sequences, terminal dinucleotide "UU" is 2'-OMe-U 2'-OMe-U, and neither the terminal TT nor the terminal UU are in the inverted/reverse orientation. In various embodiments UU as standard RNA can also be used.

The terminal dithymidine (or TT or dTdT or sdTsdT or UU or the like) is not part of the Beta-Catenin target sequence, but is a modified variant of the dithymidine dinucleotide commonly placed as an overhang to protect the ends of siRNAs from nucleases (see, for example, Elbashir et al. 2001 Nature 411: 494-498; Elbashir et al. 2001 EMBO J. 20: 6877-6888; and Kraynack et al. 2006 RNA 12:163-176). A terminal dinucleotide is known from these references to enhance nuclease resistance but not contribute to target recognition. On any modified or unmodified sequence, a 3' end cap, as is known in the art, can be used instead of a terminal dinucleotide to stabilize the end from nuclease degradation provided that the 3' end cap is able to both stabilize the RNAi agent (e.g., against nucleases) and not interfere excessively with siRNA activity.

Table 4 provides sets of overlapping RNAi agents to Beta-Catenin.

Activity levels of various Beta-Catenin RNAi agents are provided in Tables 5 to 9.

RNAi Agent Comprising an Anti-Sense Strand of a RNAi Agent Described Herein

In one particular specific embodiment, the present disclosure relates to a composition comprising a RNAi agent for inhibition of the target gene Beta-Catenin comprising an anti-sense strand, wherein the anti-sense strand comprises at least 15 contiguous nucleotides differing by 0, 1, 2, or 3 nucleotides from the anti-sense strand of a RNAi agent to Beta-Catenin selected from those anti-sense strands in the specific duplexes provided herein and as listed, e.g., in Tables 1, 2, 3, 4, 5, 6, 7, 8 and/or 9.

In one embodiment, the composition comprises a RNAi agent for inhibition of the target gene Beta-Catenin comprising a sense and an anti-sense strand, wherein the sequence of the sense strand and the sequence of the anti-sense strand are the sequences of the sense and anti-sense strand, respectively, of any RNAi agent provided herein. In one embodiment, the composition comprises a RNAi agent for inhibition of the target gene Beta-Catenin comprising a sense and an anti-sense strand, wherein the sequence of the antisense strand is the sequence of antisense strand of any RNAi agent provided herein. In one embodiment, the composition comprises a RNAi agent for inhibition of the target gene Beta-Catenin comprising a sense and an anti-sense strand, wherein the sequence of the sense strand and the sequence of the anti-sense strand are the sequences of the sense and anti-sense strand, respectively, of any RNAi agent provided herein, further comprising an additional about 6 to 20 nucleotides on one or both strands (e.g., about 6, 7, 8, 9, 10, 11, 12, 13, 14, 15, 16, 17, 18, 19 or 20 nt). In one embodiment, the composition comprises a RNAi agent for inhibition of the target gene Beta-Catenin comprising a sense and an anti-sense strand, wherein the sequence of the anti-sense strand is the sequence of the anti-sense strand of any RNAi agent provided herein, further comprising an additional about 6 to 20 nucleotides on one or both strands (e.g., about 6, 7, 8, 9, 10, 11, 12, 13, 14, 15, 16, 17, 18, 19 or 20 nt). In these various embodiments, the RNAi agent is for inhibition of the target gene Beta-Catenin.

Various specific embodiments of these embodiments are described below.

In one embodiment, the composition further comprises a second RNAi agent to Beta-Catenin. In various embodiments, the second RNAi agent is physically separate from the first, or the two are physically connected (e.g., covalently linked or otherwise conjugated), or combined within the same pharmaceutical composition.

In one embodiment, the antisense strand is about 30 or fewer nt in length.

In one embodiment, the sense strand and the antisense strand form a duplex region of about 15 to about 30 nucleotide pairs in length.

In one embodiment, the antisense strand is about 15 to about 36 nt in length, about 17 to about 30 nt in length, about 17 to 23 nt in length, about 19 to about 49 nt in length, or about 19 to about 23 nt in length. In one embodiment, the antisense strand has at least the length selected from about 15 nt, about 16 nt, about 17 nt, about 18 nt, about 19 nt, about 20 nt, about 21 nt, about 22 nt, about 23 nt, about 24 nt, about 25 nt, about 26 nt, about 27 nt, about 28 nt, about 29 nt and about 30 nt.

In one embodiment, the RNAi agent comprises a modification that causes the RNAi agent to have increased stability in a biological sample or environment, e.g., blood serum or intestinal lavage fluid.

In one embodiment, the RNAi agent comprises at least one sugar backbone modification (e.g., phosphorothioate linkage) and/or at least one 2'-modified nucleotide. In one embodiment, all the pyrimidines are 2' O-methyl-modified nucleotides.

In one embodiment, the RNAi agent comprises: at least one 5'-uridine-adenine-3' (5'-ua-3') dinucleotide, wherein the uridine is a 2'-modified nucleotide; and/or at least one 5'-uridine-guanine-3' (5'-ug-3') dinucleotide, wherein the 5'-uridine is a 2'-modified nucleotide; and/or at least one 5'-cytidine-adenine-3' (5'-ca-3') dinucleotide, wherein the 5'-cytidine is a 2'-modified nucleotide; and/or at least one 5'-uridine-uridine-3' (5'-uu-3') dinucleotide, wherein the 5'-uridine is a 2'-modified nucleotide.

In one embodiment, the RNAi agent comprises a 2'-modification selected from the group consisting of: 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), and 2'-O—N-methylacetamido (2'-O-NMA). In one embodiment, all the pyrimidines are 2' O-methyl-modified nucleotides.

In one embodiment, the RNAi agent comprises a blunt end.

In one embodiment, the RNAi agent comprises an overhang having 1 to 4 unpaired nucleotides.

In one embodiment, the RNAi agent comprises an overhang at the 3'-end of the antisense strand of the RNAi agent.

In one embodiment, the RNAi agent is ligated to one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

In one embodiment, the RNAi agent is capable of inhibiting expression of the Beta-Catenin gene by at least about 60% at a concentration of 10 nM in HeLa cells in vitro.

In one embodiment, the RNAi agent is capable of inhibiting expression of the Beta-Catenin gene by at least about 70% at a concentration of 10 nM in HeLa cells in vitro.

In one embodiment, the RNAi agent is capable of inhibiting expression of the Beta-Catenin gene by at least about 80% at a concentration of 10 nM in HeLa cells in vitro.

In one embodiment, the RNAi agent is capable of inhibiting expression of the Beta-Catenin gene by at least about 90% at a concentration of 10 nM in HeLa cells in vitro.

In one embodiment, the RNAi has an EC50 of no more than about 0.1 nM.

In one embodiment, the RNAi has an EC50 of no more than about 0.01 nM.

In one embodiment, the RNAi has an EC50 of no more than about 0.001 nM.

A RNAi Agent Comprising a First and a Second Strand

In one particular specific embodiment, the present disclosure relates to a composition comprising a RNAi agent for inhibition of the target gene Beta-Catenin comprising a first strand and a second strand, wherein the first strand and second strand comprise at least 15 contiguous nucleotides, each differing by 0, 1, 2, or 3 nucleotides from the first and second strand, respectively, of a RNAi agent to Beta-Catenin selected from the specific duplexes provided herein and listed, e.g., in Tables 1, 2, 3, 4, 5, 6, 7, 8 and/or 9. In these various embodiments, the RNAi agent is for inhibition of the target gene Beta-Catenin.

Various specific embodiments of this embodiment are described below.

In one embodiment, the composition further comprises a second RNAi agent to Beta-Catenin. In various embodiments, the second RNAi agent is physically separate from the first, or the two are physically connected (e.g., covalently linked or otherwise conjugated), or combined within the same pharmaceutical composition.

In one embodiment, the antisense strand is about 30 or fewer nt in length.

In one embodiment, the sense strand and the antisense strand form a duplex region of about 15 to about 30 nt pairs in length.

In one embodiment, the antisense strand is about 15 to about 36 nt in length, including about 17 to about 23 nt in length, and including about 19 to about 23 nt in length. In one embodiment, the antisense strand has at least the length selected from about 15 nt, about 16 nt, about 17 nt, about 18 nt, about 19 nt, about 20 nt, about 21 nt, about 22 nt, about 23 nt, about 24 nt, about 25 nt, about 26 nt, about 27 nt, about 28 nt, about 29 nt and about 30 nt.

In one embodiment, the RNAi agent comprises a modification that causes the RNAi agent to have increased stability in a biological sample or environment, e.g., blood serum or intestinal lavage fluid.

In one embodiment, the RNAi agent comprises at least one sugar backbone modification (e.g., phosphorothioate linkage) and/or at least one 2'-modified nucleotide. In one embodiment, all the pyrimidines are 2' O-methyl-modified nucleotides.

In one embodiment, the RNAi agent comprises: at least one 5'-uridine-adenine-3' (5'-ua-3') dinucleotide, wherein the uridine is a 2'-modified nucleotide; and/or at least one 5'-uridine-guanine-3' (5'-ug-3') dinucleotide, wherein the 5'-uridine is a 2'-modified nucleotide; and/or at least one 5'-cytidine-adenine-3' (5'-ca-3') dinucleotide, wherein the 5'-cytidine is a 2'-modified nucleotide; and/or at least one 5'-uridine-uridine-3' (5'-uu-3') dinucleotide, wherein the 5'-uridine is a 2'-modified nucleotide.

In one embodiment, the RNAi agent comprises a 2'-modification selected from the group consisting of: 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), and 2'-O—N-methylacetamido (2'-O-NMA).

In one embodiment, the RNAi agent comprises a blunt end.

In one embodiment, the RNAi agent comprises an overhang having 1 to 4 unpaired nucleotides.

In one embodiment, the RNAi agent comprises an overhang at the 3'-end of the antisense strand of the RNAi agent.

In one embodiment, the RNAi agent is ligated to one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

In one embodiment, the RNAi agent is capable of inhibiting expression of the Beta-Catenin gene by at least about 60% at a concentration of 10 nM in HeLa cells in vitro.

In one embodiment, the RNAi agent is capable of inhibiting expression of the Beta-Catenin gene by at least about 70% at a concentration of 10 nM in HeLa cells in vitro.

In one embodiment, the RNAi agent is capable of inhibiting expression of the Beta-Catenin gene by at least about 80% at a concentration of 10 nM in HeLa cells in vitro.

In one embodiment, the RNAi agent is capable of inhibiting expression of the Beta-Catenin gene by at least about 90% at a concentration of 10 nM in HeLa cells in vitro.

In one embodiment, the RNAi has an EC50 of no more than about 0.1 nM.

In one embodiment, the RNAi has an EC50 of no more than about 0.01 nM.

In one embodiment, the RNAi has an EC50 of no more than about 0.001 nM.

A Method of Treatment Using a RNAi Agent Described Herein

In one particular specific embodiment, the present disclosure relates to a method of treating a Beta-Catenin-related disease in an individual, comprising the step of administering to the individual a therapeutically effective amount of a composition comprising any one or more of the RNAi agents disclosed herein. In one embodiment of this method, the RNAi agent comprises at least an antisense strand, wherein the antisense strand comprises at least 15 contiguous nucleotides differing by 0, 1, 2, or 3 nucleotides from the antisense strand of a RNAi agent to Beta-Catenin selected from the specific duplexes provided herein and as listed, e.g., in Tables 1, 2, 3, 4, 5, 6, 7, 8 and/or 9. In one embodiment, the RNAi agent comprises a sense and an anti-sense strand, wherein the sense strand comprises at least 15 contiguous nucleotides differing by 0, 1, 2, or 3 nucleotides from the sense strand of a RNAi agent to Beta-Catenin selected from the specific duplexes provided herein and as listed, e.g., in Tables 1, 2, 3, 4, 5, 6, 7, 8 and/or 9. In one embodiment, the RNAi agent comprises a first and a second strand, wherein the first strand comprises at least 15 contiguous nucleotides differing by 0, 1, 2, or 3 nucleotides from the first strand of a RNAi agent to Beta-Catenin selected from the specific duplexes provided herein and as listed, e.g., in Tables 1, 2, 3, 4, 5, 6, 7, 8 and/or 9. In one embodiment, the RNAi agent comprises a first and a second strand, wherein the sequence of the first strand comprises the sequence of the first strand of a RNAi agent to Beta-Catenin selected from the specific duplexes provided herein and as listed, e.g., in Tables 1, 2, 3, 4, 5, 6, 7, 8 and/or 9. In one embodiment, the RNAi agent comprises a first and a second strand, wherein the sequence of the first strand is the sequence of the first strand of a RNAi agent to Beta-Catenin selected from the specific duplexes provided herein and as listed, e.g., in Tables 1, 2, 3, 4, 5, 6, 7, 8 and/or 9. In these various embodiments, the RNAi agent is for the inhibition of the target gene Beta-Catenin.

Various particular specific embodiments of these embodiments are described below.

In one embodiment, the Beta-Catenin-related disease is adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and/or impaired wound healing, and/or similar and related diseases.

In one embodiment, the Beta-Catenin-related disease is cancer.

In one embodiment, the method further comprises the administration of an additional treatment. In one embodiment, the additional treatment is a therapeutically effective amount of a composition.

In one embodiment, the additional treatment is a method (or procedure).

In one embodiment, the additional treatment and the RNAi agent can be administered in any order, or can be administered simultaneously.

In one embodiment, the method further comprises the step of administering an additional treatment for adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and/or impaired wound healing, and/or similar and related diseases.

In one embodiment, the composition comprises a second RNAi agent to Beta-Catenin. In various embodiments, the second RNAi agent is physically separate from the first, or the two are physically connected (e.g., covalently linked or otherwise conjugated), or combined within the same pharmaceutical composition.

In one embodiment, the method further comprises the step of administering an additional RNAi agent which comprises at least 15 contiguous nucleotides differing by 0, 1, 2, or 3 nucleotides from the antisense strand of a RNAi agent to Beta-Catenin selected from the specific duplexes provided herein and as listed, e.g., in Tables 1, 2, 3, 4, 5, 6, 7, 8 and/or 9.

Inhibiting the Expression of Beta-Catenin, Using a RNAi Agent

In one particular specific embodiment, the present disclosure relates to a method of inhibiting the expression of the Beta-Catenin gene in an individual, comprising the step of administering to the individual a therapeutically effective amount of a composition comprising any one or more of the RNAi agents of the present disclosure. In one embodiment, the RNAi agent comprises at least an anti-sense strand, and/or comprises a sense and an anti-sense strand, wherein the anti-sense strand comprises at least 15 contiguous nucleotides differing by 0, 1, 2, or 3 nucleotides from the anti-sense strand of a RNAi agent to Beta-Catenin selected from those specific duplex provided herein and as listed, e.g., in Tables 1, 2, 3, 4, 5, 6, 7, 8 and/or 9. In one embodiment, the RNAi agent comprises a sense and an anti-sense strand, wherein the anti-sense strand comprises at least 15 contiguous nucleotides differing by 0, 1, 2, or 3 nucleotides from the anti-sense strand of a RNAi agent to Beta-Catenin selected from those specific duplex provided herein and as listed, e.g., in Tables 1, 2, 3, 4, 5, 6, 7, 8 and/or 9. In one embodiment, the RNAi agent comprises a first and a second strand, wherein the sequence of the first strand comprises sequence of the first strand of a RNAi agent to Beta-Catenin selected from those specific duplex provided herein and as listed, e.g., in Tables 1, 2, 3, 4, 5, 6, 7, 8 and/or 9. In one embodiment, the RNAi agent comprises a first and a second strand, wherein the sequence of the first strand is sequence of the first strand of a RNAi agent to Beta-Catenin selected from those specific duplex provided herein and as listed, e.g., in Tables 1, 2, 3, 4, 5, 6, 7, 8 and/or 9.

Various embodiments of this aspect of these embodiments are described below.

In one embodiment, the individual is afflicted with or susceptible to a Beta-Catenin-related disease.

In one embodiment, the Beta-Catenin-related disease is adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and/or impaired wound healing, and/or similar and related diseases.

In one embodiment, the Beta-Catenin-related disease is cancer.

In one embodiment, the method further comprises the administration of an additional treatment. In one embodiment, the additional treatment is a therapeutically effective amount of a composition.

In one embodiment, the additional treatment is a method (or procedure).

In one embodiment, the additional treatment and the RNAi agent can be administered in any order or can be administered simultaneously.

In one embodiment, the method further comprises the step of administering an additional treatment for adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and/or impaired wound healing, and/or similar and related diseases.

In one embodiment, the composition comprises a second RNAi agent to Beta-Catenin. In various embodiments, the second RNAi agent is physically separate from the first, or the two are physically connected (e.g., covalently linked or otherwise conjugated), or combined within the same pharmaceutical composition.

In one embodiment, the method further comprises the step of administering an additional RNAi agent which comprises at least 15 contiguous nucleotides differing by 0, 1, 2, or 3 nucleotides from the antisense strand of a RNAi agent to Beta-Catenin selected from the specific duplexes provided herein and as listed, e.g., in Tables 1, 2, 3, 4, 5, 6, 7, 8 and/or 9.

Pharmaceutical Formulations of a RNAi Agent to Beta-Catenin

In one particular specific embodiment, the present disclosure relates to a composition comprising any one or more of the RNAi agents of the present disclosure. In one embodiment, the RNAi agent comprises at least an anti-sense strand, and/or comprises a sense and an anti-sense strand, wherein the anti-sense strand comprises at least 15 contiguous nucleotides differing by 0, 1, 2, or 3 nucleotides from the anti-sense strand of a RNAi agent to Beta-Catenin selected from those specific duplex provided herein and as listed, e.g., in Tables 1, 2, 3, 4, 5, 6, 7, 8 and/or 9, wherein the composition is in a pharmaceutically effective formulation. In one embodiment, the RNAi agent comprises a first and a second strand, wherein the sequence of the first strand comprises at least 15 contiguous nucleotides differing by 0, 1, 2, or 3 nucleotides from the sequence of the first strand of a RNAi agent to Beta-Catenin selected from those specific duplex provided herein and as listed, e.g., in Tables 1, 2, 3, 4, 5, 6, 7, 8 and/or 9, wherein the composition is in a pharmaceutically effective formulation. In one embodiment, the RNAi agent comprises a first and a second strand, wherein the sequence of the first strand comprises the sequence of the first strand of a RNAi agent to Beta-Catenin selected from those specific duplex provided herein and as listed, e.g., in Tables 1, 2, 3, 4, 5, 6, 7, 8 and/or 9, wherein the composition is in a pharmaceutically effective formulation. In one embodiment, the RNAi agent comprises a first and a second strand, wherein the sequence of the first strand is the sequence of the first strand of a RNAi agent to Beta-Catenin selected from those specific duplex provided herein and as listed, e.g., in Tables 1, 2, 3, 4, 5, 6, 7, 8 and/or 9, wherein the composition is in a pharmaceutically effective formulation.

In one embodiment, the present disclosure pertains to the use of a RNAi agent in the manufacture of a medicament for treatment of a Beta-Catenin-related disease, wherein the RNAi agent is any RNAi disclosed herein. In one embodiment, the RNAi agent comprises a sense strand and an antisense strand, wherein the antisense strand comprises at least 15 contiguous nucleotides differing by 0, 1, 2, or 3 nucleotides from the antisense strand of a RNAi agent to Beta-Catenin selected from those specific duplex provided herein and as listed, e.g., in Tables 1, 2, 3, 4, 5, 6, 7, 8 and/or 9. In one embodiment, the RNAi agent comprises at least an anti-sense strand, and/or comprises a sense and an anti-sense strand, wherein the anti-sense strand comprises at least 15 contiguous nucleotides differing by 0, 1, 2, or 3 nucleotides from the anti-sense strand of a RNAi agent to Beta-Catenin selected from those specific duplex provided herein and as listed, e.g., in Tables 1, 2, 3, 4, 5, 6, 7, 8 and/or 9, wherein the composition is in a pharmaceutically effective formulation. In one embodiment, the RNAi agent comprises a first and a second strand, wherein the sequence of the first strand comprises at least 15 contiguous nucleotides differing by 0, 1, 2, or 3 nucleotides from the sequence of the first strand of a RNAi agent to Beta-Catenin selected from those specific duplex provided herein and as listed, e.g., in Tables 1, 2, 3, 4, 5, 6, 7, 8 and/or 9, wherein the composition is in a pharmaceutically effective formulation. In one embodiment, the RNAi agent comprises a first and a second strand, wherein the sequence of the first strand comprises the sequence of the first strand of a RNAi agent to Beta-Catenin selected from those specific duplex provided herein and as listed, e.g., in Tables 1, 2, 3, 4, 5, 6, 7, 8 and/or 9, wherein the composition is in a pharmaceutically effective formulation. In one embodiment, the RNAi agent comprises a first and a second strand, wherein the sequence of the first strand is the sequence of the first strand of a RNAi agent to Beta-Catenin selected from those specific duplex provided herein and as listed, e.g., in Tables 1, 2, 3, 4, 5, 6, 7, 8 and/or 9, wherein the composition is in a pharmaceutically effective formulation.

Specific Embodiments of RNAi Agents to Beta-Catenin Comprising Mismatches from the Disclosed Sequences Various specific embodiments of a RNAi agent to Beta-Catenin are disclosed herein. The present disclosure encompasses the example modified sequences provided in Tables 1, 2, 3, 4, 5, 6, 7, 8 and/or 9, and the corresponding unmodified sequences and other modified sequences (e.g., modified and unmodified variants). Specific embodiments of the present disclosure include RNAi agents which comprise sequences differing by 0, 1, 2, or 3 nt (nucleotides) or by [basepair(s)] (e.g., with 0, 1, 2 or 3 mismatches) from any of the RNAi agents listed in Table 1, and modified and unmodified variants thereof. As described in additional detail below, a mismatch is defined herein as a difference between the base sequence (e.g., A instead of G) or length when two sequences are maximally aligned and compared. In addition, as described in more detail below, an "unmodified variant" is a variant in which the base sequence is identical, but none of the bases are modified; this includes, for example, the corresponding portion of the wild-type Beta-Catenin mRNA or gene. A "modified variant" contains one or more modifications (or one or more fewer or different modifications) to a nucleotide, sugar, phosphate or backbone, and/or addition of one or more moieties; but without a change, substitution, addition, or deletion to the base sequence. A particular sequence and its modified or unmodified variants have 0 mismatches among them.

In one particular embodiment, the present disclosure comprises a RNAi agent comprising a anti-sense strand comprising at least 15 contiguous nucleotides differing by 0, 1, 2, or 3 nt from the sequence of the anti-sense strand of: any of the RNAi agents listed in Tables 1, 2, 3, 4, 5, 6, 7, 8 and/or 9, and modified and unmodified variants thereof.

In another particular embodiment, the RNAi agent comprises a sense strand comprising at least 15 contiguous nucleotides differing by 0, 1, 2, or 3 nt from the sense strand of any of the RNAi agents listed in Tables 1, 2, 3, 4, 5, 6, 7, 8 and/or 9, and modified and unmodified variants thereof.

Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

OTHER EMBODIMENTS

Various particular specific embodiments of this disclosure are described below.

In one embodiment, the disclosure pertains to a composition according to any of the disclosed embodiments, for use in a method of treating a Beta-Catenin-related disease in an individual, the method comprising the step of administering to the individual a therapeutically effective amount of a composition according to the disclosure.

Various particular specific embodiments of this embodiment are described below.

In one embodiment, the disclosure pertains to the composition according to any of the above embodiments, for use in a method of inhibiting the expression of Beta-Catenin in an individual, the method comprising the step of administering to the individual a therapeutically effective amount of a composition according to any of the disclosed embodiments.

One embodiment of the disclosure is the use of a composition according to any of the above embodiments, in the manufacture of a medicament for treatment of an Beta-Catenin-related disease.

In one embodiment, the Beta-Catenin-related disease is selected from cancer, viral disease or autoimmune disease.

In one embodiment, the disclosure pertains to the composition of any of the above embodiments, for use in the treatment of an Beta-Catenin-related disease.

In one embodiment, the Beta-Catenin-related disease is selected from cancer, viral disease or autoimmune disease.

In one embodiment, the disclosure relates to a method of inhibiting the expression of Beta-Catenin in an cell, comprising the step of introducing into the cell a composition comprising an RNAi agent comprising an antisense strand, wherein the antisense strand comprises at least 15 contiguous nucleotides differing by 0, 1, 2, or 3 nucleotides from the antisense strand of an RNAi agent to Beta-Catenin selected from the Beta-Catenin siRNAs disclosed herein.

In one embodiment, the disclosure relates to a method of inhibiting the expression of Beta-Catenin in an cell, comprising the step of introducing into the cell a composition comprising an RNAi agent comprising a sense strand and an antisense strand, wherein the antisense strand comprises at least 15 contiguous nucleotides differing by 0, 1, 2, or 3 nucleotides from the antisense strand, and the sense strand comprises at least 15 contiguous nucleotides differing by 0, 1, 2, or 3 nucleotides from the sense strand of an RNAi agent to Beta-Catenin selected from the Beta-Catenin siRNAs disclosed herein.

Beta-Catenin

By "Beta-Catenin" is meant the gene, mRNA, and/or protein, or any nucleic acid encoding the protein, also designated cadherin-associated protein beta 1; CTNNB1; CTNNB; CTNNB; CTNB1; FLJ25606; OMIM: 116806; MGI: 88276 HomoloGene: 1434; OTTHUMP00000209288; DKFZp686D02253; HGNC: 2514; Entrez Gene: 1499; Ensembl: ENSG00000168036; UniProtKB: P35222; GC03P040551; GC03P041054; or GC03P041201. See: Kraus et al. 1994. Genomics 23: 272-4.

Beta-Catenin is involved in the regulation of cell adhesion and in signal transduction through the Wnt pathway. It is part of a complex of proteins that constitute adherens junctions (AJs). AJs are necessary for the creation and maintenance of epithelial cell layers and regulate cell growth and adhesion between cells. Beta-Catenin also anchors the actin cytoskeleton and may be responsible for transmitting the contact inhibition signal that causes cells to stop dividing once the epithelial sheet is complete.

When Beta-Catenin was sequenced, it was found to be a member of the armadillo family of proteins. These proteins have multiple copies of the so-called armadillo repeat domain, which is specialized for protein-protein binding. When Beta-Catenin is not associated with cadherins and alpha-catenin, it can interact with other proteins such as ICAT and APC.

Beta-Catenin is also involved in the Wnt pathway. When Wnt is not present, GSK-3 (a kinase) constitutively phosphorylates the Beta-Catenin protein. Beta-Catenin is associated with axin (scaffolding protein) complexed with GSK-3 and APC (adenomatosis polyposis coli). The creation of this complex increases the phosphorylation of Beta-Catenin by facilitating the activity of GSK-3. When Beta-Catenin is phosphorylated, it is degraded and thus does not significantly accumulate in the cell. When Wnt binds to frizzled (Fz), its receptor, dishevelled (Dsh), is recruited to the membrane. GSK-3 is inhibited by the activation of Dsh by Fz. Because of this, Beta-Catenin is permitted to accumulate in the cytosol and can be translocated to the nucleus, where it performs several functions. It can act in conjunction with TCF/LEF transcription factors to activate target genes involved in different processes, including proliferation, survival and matrix remodeling.

Beta-Catenin interacts with many other proteins, including: cadherins, transcription factors, axin, galectin-3, beta-galactoside-binding protein, GSK-3, protein kinase A, Androgen receptor, APC, AXIN1, CBY1, CDH1, CDH2, CDH3, CDK5R1, CHUK, CTNNA1, CTNND1, EGFR, FHL2, HER2/neu, HNF4A, IKK2, LEF1, MAGI1, MUC1, NF5A1, PCAF, PHF17, Plakoglobin, PTPN14, PTPRF, PRPRK, PSEN1, RuvB-like 1, SMAD7, SLC913R1, SMARCA4, USP9X, and VE-cadherin.

Beta-Catenin is associated with several diseases. Beta-Catenin itself can act as an oncogene. In adenomatous polyposis of the colon, the APC gene, whose product binds Beta-Catenin, is mutated. As described in more detail below, mutations in, over-expression of, and/or abnormal cellular compartmentalization (e.g., aberrant accumulation in the cytoplasm and/or nucleus) of Beta-Catenin are associated with various diseases, including: adenomatous polyposis of the colon, colorectal cancer, basal cell carcinoma, pilomatrixoma, medulloblastoma, ovarian cancer, adrenocortical tumors, gastric cancer, liver cancer, melanoma, prostate cancer, renal cancer, ectopic teeth and taste papillae, skin cancer, anaplastic thyroid carcinoma, and uterine carcinosarcoma. See: Thompson et al. 2007 Hepatology 45: 1298-305; Wang et al. 2008 Cancer Epidemiol. Biomarkers Prev. 17: 2101-8; Saldanha et al. Br. J. Dermatol. 151: 157-64.

Nuclear and cytosolic accumulation (e.g., improper cellular compartmentalization) is enriched in basal-like breast cancer and are associated with poor outcome. Beta-Catenin accumulation is more often observed in basal-like in situ carcinomas than in other sub-types, suggesting that activation of this pathway might be an early event in basal-like tumor development. Khramtsov et al. 2010 Am. J. Pathol. 176: 2911-2920.

Sequences and Structure of Beta-Catenin

Three human transcript variants encoding the same protein have been found for this gene: NP_001091679.1; NP_001091680.1; and NP_001895.1. The amino acid and nucleotide sequences of human Beta-Catenin are provided in LOCUS NM_001098209 (ACCESSION NM_001098209 XM_001133660 XM_001133664 XM_001133673 XM_001133675; VERSION NM_001098209.1 GI:148233337); LOCUS NM_001098210 (ACCESSION NM_001098210; VERSION NM_001098210.1 GI:148227671); and LOCUS NM_001904 (ACCESSION NM_001904 XM_942045 XM_945648 XM_945650 XM_945651 XM_945652 XM_945653 XM_945654 XM_945655 XM_945657; VERSION NM_001904.3 GI:148228165).

The mouse (*Mus musculus*) sequence of Beta-Catenin is available as Q02248 (CTNB1_MOUSE); MGI:88276; NP_031640.1 GI:6671684; NM_007614.3. The rat (*Rattus norvegicus*) sequence is available as Q9WU82 (CTNB1_RAT); Li et al. 2002 Gene 283: 255-62.

A RNAi agent specific to Beta-Catenin can be designed such that the sequence thereof completely matches that of the mRNA corresponding to the human Beta-Catenin gene and the homologous gene from a test animal. Thus, the exact same RNAi agent can be used in both test animals (e.g., rat, mouse, cynomolgus monkey, etc.) and humans. The sequences for the various Beta-Catenin genes have been determined in many species, including humans, mice and rats (as described above).

The Beta-Catenin sequence in cynomolgus monkey (*Macaca fascicularis*, or "cyno") has been determined.

The alignment of the cyno and human (NM_001098210.1) Beta-Catenin mRNA sequences is shown below.

```
Human  AGGATACAGCGGCTTCTGCGCGACTTATAAGAGCTCCTTGTGCGGCGCCATTTTAAGCCT   60
Cyno   --------------------------------------------CGCCATTTTAAGCCT   15
                                                   ***************

Human  CTCGGTCTGTGGCAGCAGCGTTGGCCCGGCCCCGGGAGCGGAGAGCGAGGGGAGGCGGAG  120
Cyno   CTTGGTCTGTGGCAGCCGTGTTGGCCCGGCCCCGAGAGCGGAGAGCGAGGGGAGGCGGAG   75
       **  ************ * ***************** *********************

Human  ACGGAGGAAGGTCTGAGGAGCAGCTTCAGTCCCCGCCGAGCCGCCACCGCAGGTCGAGGA  180
Cyno   ACGGAGGAAGGTCCGAGGAGCAGCTTCAGTCCTCGCCGAGCCGCCACCGCAGGTCGAGGA  135
       ************* ****************** ***************************

Human  CGGTCGGACTCCCGCGGCGGGAGGAGCCTGTTCCCCTGAGGGTATTTGAAGTATACCATA  240
Cyno   CGGTCGGACTCCCGCGACGGGAGGAGCCTGTTCCCCTGAGGGTATTTGAAGTATACCATA  195
       **************** *******************************************

Human  CAACTGTTTTGAAAATCCAGCGTGGACAATGGCTACTCAAGCTGATTTGATGGAGTTGGA  300
Cyno   CAACTGTTTTGAAAATCCAGCGTGGACAATGGCTACTCAAGCTGATTTGATGGAGTTGGA  255
       ************************************************************

Human  CATGGCCATGGAACCAGACAGAAAAGCGGCTGTTAGTCACTGGCAGCAACAGTCTTACCT  360
Cyno   CATGGCCATGGAACCAGACAGAAAAGCGGCTGTTAGTCACTGGCAGCAACAGTCTTACCT  315
       ************************************************************

Human  GGACTCTGGAATCCATTCTGGTGCCACTACCACAGCTCCTTCTCTGAGTGGTAAAGGCAA  420
Cyno   GGACTCTGGAATCCATTCTGGTGCCACTACCACAGCTCCTTCTCTGAGTGGTAAAGGCAA  375
       ************************************************************

Human  TCCTGAGGAAGAGGATGTGGATACCTCCCAAGTCCTGTATGAGTGGGAACAGGGATTTTC  480
Cyno   TCCTGAGGAAGAGGATGTGGATACCTCCCAAGTCCTGTATGAGTGGGAACAGGGATTTTC  435
       ************************************************************

Human  TCAGTCCTTCACTCAAGAACAAGTAGCTGATATTGATGGACAGTATGCAATGACTCGAGC  540
Cyno   TCAGTCCTTCACTCAAGAACAAGTAGCTGATATTGATGGACAGTATGCAATGACTCGAGC  495
       ************************************************************

Human  TCAGAGGGTACGAGCTGCTATGTTCCCTGAGACATTAGATGAGGGCATGCAGATCCCATC  600
Cyno   TCAGAGGGTACGAGCTGCTATGTTCCCTGAGACATTAGATGAGGGCATGCAGATCCCATC  555
       ************************************************************

Human  TACACAGTTTGATGCTGCTCATCCCACTAATGTCCAGCGTTTGGCTGAACCATCACAGAT  660
Cyno   TACACAGTTTGATGCTGCTCATCCCACTAATGTCCAGCGTTTGGCTGAACCATCACAGAT  615
       ************************************************************

Human  GCTGAAACATGCAGTTGTAAACTTGATTAACTATCAAGATGATGCAGAACTTGCCACACG  720
Cyno   GCTGAAACATGCAGTTGTAAACTTGATTAACTATCAAGATGATGCAGAACTTGCCACACG  675
       ************************************************************

Human  TGCAATCCCTGAACTGACAAAACTGCTAAATGACGAGGACCAGGTGGTGGTTAATAAGGC  780
Cyno   TGCAATCCCTGAACTGACAAAACTGCTAAATGATGAGGACCAGGTGGTGGTTAATAAGGC  735
       ********************************* **************************

Human  TGCAGTTATGGTCCATCAGCTTTCTAAAAAGGAAGCTTCCAGACACGCTATCATGCGTTC  840
Cyno   TGCAGTTATGGTCCATCAGCTTTCTAAAAAGGAAGCTTCCAGACACGCTATCATGCGTTC  795
       ************************************************************

Human  TCCTCAGATGGTGTCTGCTATTGTACGTACCATGCAGAATACAAATGATGTAGAAACAGC  900
Cyno   TCCTCAGATGGTGTCTGCTATTGTACGTACCATGCAGAATACAAATGATGTAGAAACAGC  855
       ************************************************************
```

```
                                                  -continued
Human    TCGTTGTACCGCTGGGACCTTGCATAACCTTTCCCATCATCGTGAGGGCTTACTGGCCAT       960
Cyno     TCGTTGTACCGCTGGGACCTTGCATAACCTTTCCCATCATCGGGAGGGCTTGTTGGCCAT       915
         ****************************************  *******  *******

Human    CTTTAAGTCTGGAGGCATTCCTGCCCTGGTGAAAATGCTTGGTTCACCAGTGGATTCTGT      1020
Cyno     CTTTAAGTCTGGAGGCATTCCTGCCCTGGTGAAAATGCTTGGTTCACCAGTGGATTCTGT       975
         ************************************************************

Human    GTTGTTTTATGCCATTACAACTCTCCACAACCTTTTATTACATCAAGAAGGAGCTAAAAT      1080
Cyno     GTTGTTTTATGCCATTACAACTCTCCACAACCTTTTATTACATCAAGAAGGAGCTAAAAT      1035
         ************************************************************

Human    GGCAGTGCGTTTAGCTGGTGGGCTGCAGAAAATGGTTGCCTTGCTCAACAAAACAAATGT      1140
Cyno     GGCAGTGCGTTTAGCTGGCGGGCTACAGAAAATGGTTGCCTTGCTCAACAAAACAAACGT      1095
         ****************** ***** ******************************** **

Human    TAAATTCTTGGCTATTACGACAGACTGCCTTCAAATTTTAGCTTATGGCAACCAAGAAAG      1200
Cyno     TAAATTCTTGGCTATTACGACAGACTGCCTTCAGATTTTAGCATATGGCAACCAAGAAAG      1155
         ********************************* ******** *****************

Human    CAAGCTCATCATACTGGCTAGTGGTGGACCCCAAGCTTTAGTAAATATAATGAGGACCTA      1260
Cyno     CAAGCTGATCATACTGGCTAGTGGTGGACCCCAAGCTTTAGTAAATATAATGAGGACCTA      1215
         ****** *****************************************************

Human    TACTTACGAAAAACTACTGTGGACCACAAGCAGAGTGCTGAAGGTGCTATCTGTCTGCTC      1320
Cyno     TACTTATGAGAAACTACTGTGGACCACAAGCAGAGTGCTGAAGGTGCTATCCGTCTGCTC      1275
         ****** ** ***************************************** ********

Human    TAGTAATAAGCCGGCTATTGTAGAAGCTGGTGAATGCAAGCTTTAGGACTTCACCTGAC      1380
Cyno     TAGTAATAAGCCAGCTATTGTAGAAGCTGGTGAATGCAAGCTTTAGGACTTCACCTGAC      1335
         ************ ***********************************************

Human    AGATCCAAGTCAACGTCTTGTTCAGAACTGTCTTTGGACTCTCAGGAATCTTTCAGATGC      1440
Cyno     AGATCCAAGTCAACGTCTTGTTCAGAACTGTCTTTGGACTCTCAGGAATCTTTCAGATGC      1395
         ************************************************************

Human    TGCAACTAAACAGGAAGGGATGGAAGGTCTCCTTGGGACTCTTGTTCAGCTTCTGGGTTC      1500
Cyno     TGCAACTAAACAGGAAGGGATGGAAGGTCTCCTTGGGACTCTTGTTCAGCTTCTGGGTTC      1455
         ************************************************************

Human    AGATGATATAAATGTGGTCACCTGTGCAGCTGGAATTCTTTCTAACCTCACTTGCAATAA      1560
Cyno     AGATGATATAAATGTGGTCACCTGTGCAGCTGGAATTCTTTCTAACCTCACTTGCAATAA      1515
         ************************************************************

Human    TTATAAGAACAAGATGATGGTCTGCCAAGTGGGTGGTATAGAGGCTCTTGTGCGTACTGT      1620
Cyno     TTATAAGAATAAGATGATGGTCTGCCAAGTGGGTGGTATAGAGGCTCTTGTGCGTACTGT      1575
         ********* **************************************************

Human    CCTTCGGGCTGGTGACAGGGAAGACATCACTGAGCCTGCCATCTGTGCTCTTCGTCATCT      1680
Cyno     CCTTCGGGCTGGTGACAGGGAAGACATCACTGAGCCTGCCATCTGTGCTCTTCGTCATCT      1635
         ************************************************************

Human    GACCAGCCGACACCAAGAAGCAGAGATGGCCCAGAATGCAGTTCGCCTTCACTATGGACT      1740
Cyno     GACCAGCCGACACCAAGAAGCAGAGATGGCCCAGAATGCAGTTCGCCTTCACTATGGACT      1695
         ************************************************************

Human    ACCAGTTGTGGTTAAGCTCTTACACCCACCATCCCACTGGCCTCTGATAAAGGCTACTGT      1800
Cyno     ACCAGTTGTGGTTAAGCTCTTACACCCACCATCCCACTGGCCTCTGATAAAGGCTACTGT      1755
         ************************************************************

Human    TGGATTGATTCGAAATCTTGCCCTTTGTCCCGCAAATCATGCACCTTTGCGTGAGCAGGG      1860
Cyno     TGGATTGATTCGAAATCTTGCCCTTTGTCCAGCAAATCATGCACCTTTGCGTGAGCAGGG      1815
         ****************************** *****************************

Human    TGCCATTCCACGACTAGTTCAGTTGCTTGTTCGTGCACATCAGGATACCCAGCGCCGTAC      1920
Cyno     TGCCATTCCACGACTAGTTCAGTTGCTTGTTCGTGCACATCAGGATACCCAGCGCCGTAC      1875
         ************************************************************

Human    GTCCATGGGTGGGACACAGCAGCAATTTGTGGAGGGGGTCCGCATGGAAGAAATAGTTGA      1980
Cyno     GTCCATGGGTGGGACACAGCAGCAATTTGTGGAGGGGGTCCGCATGGAAGAAATAGTTGA      1935
         ************************************************************

Human    AGGTTGTACCGGAGCCCTTCACATCCTAGCTCGGGATGTTCACAACCGAATTGTTATCAG      2040
Cyno     AGGTTGTACTGGAGCCCTTCACATCCTAGCTCGGGATGTTCACAACCGAATTGTAATCAG      1995
         ********* ******************************************** *****

Human    AGGACTAAATACCATTCCATTGTTTGTGCAGCTGCTTTATTCTCCCATTGAAAACATCCA      2100
Cyno     AGGACTAAATACCATTCCATTGTTTGTGCAGCTGCTTTATTCTCCCATTGAAAACATCCA      2055
         ************************************************************
```

```
Human  AAGAGTAGCTGCAGGGGTCCTCTGTGAACTTGCTCAGGACAAGGAAGCTGCAGAAGCTAT    2160
Cyno   AAGAGTAGCTGCAGGGGTCCTCTGTGAACTTGCTCAGGACAAGGAAGCTGCAGAAGCGAT    2115
       *********************************************************  **

Human  TGAAGCTGAGGGAGCCACAGCTCCTCTGACAGAGTTACTTCACTCTAGGAATGAAGGTGT    2220
Cyno   TGAAGCTGAGGGAGCCACAGCTCCTCTGACAGAGTTACTTCACTCTAGGAATGAAGGTGT    2175
       ************************************************************

Human  GGCGACATATGCAGCTGCTGTTTTGTTCCGAATGTCTGAGGACAAGCCACAAGATTACAA    2280
Cyno   GGCGACGTATGCAGCTGCTGTTTTGTTCCGAATGTCTGAGGACAAGCCACAAGATTACAA    2235
       ******  ****************************************************

Human  GAAACGGCTTTCAGTTGAGCTGACCAGCTCTCTCTTCAGAACAGAGCCAATGGCTTGGAA    2340
Cyno   GAAACGGCTTTCAGTTGAGCTGACCAGCTCTCTCTTCAGAACGGAGCCAATGGCTTGGAA    2295
       ****************************************** *****************

Human  TGAGACTGCTGATCTTGGACTTGATATTGGTGCCCAGGGAGAACCCCTTGGATATCGCCA    2400
Cyno   TGAGACTGCGGATCTTGGACTTGATATTGGTGCCCAGGGAGAACCCCTTGGATATCGCCA    2355
       ********* **************************************************

Human  GGATGATCCTAGCTATCGTTCTTTTCACTCTGGTGGATATGGCCAGGATGCCTTGGGTAT    2460
Cyno   GGATGATCCTAGCTATCGTTCTTTTCACTCTGGTGGATATGGCCAGGATGCCTTGGGTAT    2415
       ************************************************************

Human  GGACCCCATGATGGAACATGAGATGGGTGGCCACCACCCTGGTGCTGACTATCCAGTTGA    2520
Cyno   GGACCCCATGATGGAACATGAGATGGGTGGCCACCACCCTGGTGCTGACTATCCAGTTGA    2475
       ************************************************************

Human  TGGGCTGCCAGATCTGGGGCATGCCCAGGACCTCATGGATGGGCTGCCTCCAGGTGACAG    2580
Cyno   TGGGCTGCCAGATCTGGGACATGCCCAGGACCTCATGGATGGGCTGCCTCCAGGTGATAG    2535
       ******************  ************************************  *

Human  CAATCAGCTGGCCTGGTTTGATACTGACCTGTAAATCATCCTTTAG---------------    2626
Cyno   CAATCAGCTGGCCTGGTTTGATACTGACCTGTAAATCATCCTTTAGCTGTATTGTCTGAA    2595
       *************************************************

Human   ------------------------------------------------------------
Cyno   CTTGCATTGTGATTGGCCTGTAGAGTTGCTGAGAGGGCTCGAGGGGTGGGCTGGTATCTC    2655

Human   ------------------------------------------------------------
Cyno   AGAAAGTGCCTGACACACTAACCAAGCTGAGTTTCCTATGGGAACAATTGAAGTAAACTT    2715

Human   ------------------------GAGTAACAATACAAATGGATTTGGGAGTGACTCA    2661
Cyno   TTTGTTCTGGTCCTTTTTGGTCGAGGAGTAACAATACAAATGGATTTTGGGAGTGACTCA    2775
                               ******************************* ******

Human  AGAAGTGAAGAATGCACAAGAATGGATCACAAGATGGAATTTATCAAACCCTAGCCTTGC    2721
Cyno   AGAAGTGAAGAATGCACAAGAATGGATCACAAGATGGAATTTATCAAACCCTAGCCTTGC    2835
       ************************************************************

Human  TTGTTAAATTTTTTTTTTTTTTTTTTTAAGAATATCTGTAATGGTACTGACTTTGCTTGC    2781
Cyno   TTGTTAAATTTTTTTTTTTTTTTTTTTAAGAATATCTGTAATGGTACTGACTTTGCTTGC    2895
       ************************************************************

Human  TTTGAAGTAGCTCTTTTTTTTTTTTTTTTTTTTTGCAGTAACTGTTTTTTAAGTCT       2841
Cyno   TTTGAAGTAGCTCTTTTTTTTTTTTTTTTTTTTTTGCAGTAACTGTTTTTTAAGTCT      2955
       **********************************  ************************

Human  CTCGTAGTGTTAAGTTATAGTGAATACTGCTACAGCAATTTCTAATTTTTAAGAATTGAG    2901
Cyno   CTCGTAGTGTTAAGTTATAGTGAATACTGCTACAGCAATTTCTAATTTTTAAGAATTGAG    3015
       ************************************************************

Human  TAATGGTGTAGAACACTAATTCATAATCACTCTAATTAATTGTAATCTGAATAAAGTGTA    2961
Cyno   TAATGGTGTAGAACACTAATTCATAATCACTCTAAT-AATTGTAATCTGAATAAAGTGTA    3074
       *********************************** ************************

Human  ACAATTGTGTAGCCTTTTTGTATAAAATAGACAAATAGAAAATGGTCCAATTAGTTTCCT    3021
Cyno   ACA-TTGTGTAGCCTTTTTGTATAAAATAGACAAATAGAAAATGGTCCAATTAGTTTCCT    3133
       *** ********************************************************

Human  TTTTAATATGCTTAAAATAAGCAGGTGGATCTATTTCATGTTTTTGATCAAAAACT--AT    3079
Cyno   TTTTAATATGCTTAAAATAAGCAGGTGGATCTATTTCATGTTTTTGATCAAAAACTTTAT    3193
       ********************************************************  **

Human  TTGGGATATGTATGGGTAGGGTAAATCAGTAAGAGGTGTTATTTGGAACCTTGTTTTGGA    3139
Cyno   TTGGGATATGTATGGGTAGGGTAAATCAGTAAGAGGTGTTATTTGGAACCTTGTTTTGGA    3253
       ************************************************************
```

```
Human  CAGTTTACCAGTTGCCTTTTATCCCAAAGTTGTTGTAACCTGCTGTGATACGATGCTTCA    3199
Cyno   CAGTTTACCAGTTGCCTTTTATCCCAAAGTTGTTGTAACCTGCTGTGATACAATGCTTCA    3313
       *********************************************** ********

Human  AGAGAAAATGCGGTTATAAAAAATGGTTCAGAATTAAACTTTTAATTCATTCGATTG       3256
Cyno   AGAGAAAATGCGGTTATAAAAAATGGTTCAGAA------------------------       3346
       *********************************

Human  (SEQ ID NO: 4112)
Cyno   (SEQ ID NO: 4113)

The start (ATG) and stop (TGA) of the cyno and human sequences are in bold,
underlined. Nucleotides matching between the human and cyno sequences are
marked with an asterisk (*). Whether or not a given sequence (e.g., a
first or second strand of a siRNA or duplex) matches the sense or anti-
sense strand of the Beta-Catenin sequence can be readily determined by
comparison of the sequences above (SEQ ID NOs: 4112 and 4113).
```

Additional Embodiments of a RNAi Agent to Beta-Catenin

The present disclosure encompasses various embodiments of RNAi agents to Beta-Catenin.

In one embodiment, the Beta-Catenin RNAi agent of the present disclosure comprises a sequence which is identical in the human, rat and cyno Beta-Catenin mRNAs. This sequence identity facilitates animal testing prior to human testing. In another embodiment, the Beta-Catenin RNAi agent comprises a sequence which is identical in the human, mouse and cyno Beta-Catenin mRNAs. In another embodiment, the Beta-Catenin RNAi agent comprises a sequence which is identical in the human and mouse Beta-Catenin mRNAs. In another embodiment, the Beta-Catenin RNAi agent comprises a sequence which is identical in the human and rat cyno Beta-Catenin mRNAs. In another embodiment, the Beta-Catenin RNAi agent comprises a sequence which is identical in the human, mouse and rat Beta-Catenin mRNAs. In another embodiment, the Beta-Catenin RNAi agent comprises a sequence which is identical in the human, rat and cyno Beta-Catenin mRNAs.

In one embodiment, the Beta-Catenin RNAi agent comprises a sequence which does not match that of any other mRNA. In one embodiment, the Beta-Catenin RNAi agent comprises a sequence which differs from all other known non-Beta-Catenin mRNAs by at least 0, 1, 2 or 3 nucleotides. In various embodiments, the Beta-Catenin RNAi agent does knock-down any other gene by more than 5, 10, 15, 20, 25, 30, or 40%. The ability of the Beta-Catenin RNAi agent to knock down other genes can be tested in vitro, or by using arrays of various genes.

Various mutations in Beta-Catenin are known; many of these are involved in Beta-Catenin-related diseases. These include mutations of the residues at 33, 37, 41 and 45, but disease-associated mutations have also been found at positions 8, 11, 13, 21, 24, 25, 28, 29, 32, 34, 39, 47, 48 and 55. In various embodiments of the present disclosure, RNAi agents can be devised to preferentially target the mutated (rather than wildtype) form of Beta-Catenin.

In other embodiments, the RNAi agents of the present disclosure bind to the 5' or 3' UTR [untranslated region(s)].

The efficacy of a RNAi agent in reducing the level of Beta-Catenin can be measured directly, e.g., measuring the levels of Beta-Catenin mRNA abundance or levels or cellular distribution of the protein itself. For example, the accumulation of Beta-Catenin in the cytoplasm and/or nucleus is associated with various disease states. After administration of a RNAi agent, cells and tissues can be tested for the accumulation of Beta-Catenin in the cytoplasm and nucleus. Alternatively, the efficacy of the RNAi can be measured indirectly by measuring the level of any one or more of the known activities of Beta-Catenin. For example, localization of Beta-Catenin to the nucleus can lead to transcription of various genes, including c-myc. After administration of a RNAi agent to Beta-Catenin, the expression of c-myc or other genes activated by Beta-Catenin can be measured.

In one embodiment, the Beta-Catenin RNAi agent of the present disclosure is administered to a patient in need thereof (e.g., a patient suffering from, suspected of having, or predisposed for, adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing, and similar and related diseases).

The patient can also be administered more than one RNAi agent specific to Beta-Catenin. In one embodiment, the Beta-Catenin RNAi agent(s) of the present disclosure can optionally be administered along with one or more additional pharmaceutical agent appropriate for that disease. In one embodiment, the Beta-Catenin RNAi agent(s) of the present disclosure can be optionally administered along with any other appropriate additional treatment, wherein the additional treatment can be a composition or a method.

Various disease states are associated with mutations in Beta-Catenin (such as those listed above), which result in over-expression, hyper-activity and/or improper cellular compartmentalization of Beta-Catenin. Mutations in components other than Beta-Catenin can also activate the Wnt signaling pathway. For example, APC (adenomatous polyposis coli) normally controls Beta-Catenin activity. APC normally builds a complex with glycogen synthase kinase 3-beta (GSK-3beta) and axin. This complex binds Beta-Catenin in the cytoplasm. With the help of casein kinase (CK1), which carries out an initial phosphyrlation of Beta-Catenin, GSK-3beta is able to phosphorylate Beta-Catenin a second time. This targets Beta-Catenin for ubiquitination and degradation by cellular proteosomes and prevents translocation of Beta-Catenin to the nucleus. APC mutations thus can result in constitutive activation of the Wnt signaling pathway. RNAi agents to Beta-Catenin can thuse be administered to patients with disease strates associated not only with mutations in Beta-Catenin but also in related mutations in other components (such as APC) of the Wnt signaling pathway.

In the case of adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing, and similar and related diseases, the RNAi agent(s) and additional disease treatment(s) can be administered in any order, simultaneously or sequentially, or in one or multiple doses over time.

In the treatment of these Beta-Catenin-related diseases, the RNAi agent(s) and additional disease treatment(s) can be administered in any order, simultaneously or sequentially, or in multiple doses over time. Administration of the RNAi agent and the additional treatment can be, for example, simultaneous, concurrent, separate or sequential.

Simultaneous administration may, e.g., take place in the form of one fixed combination with two or more active ingredients, or by simultaneously administering two or more active ingredients that are formulated independently. Sequential use (administration) preferably means administration of one (or more) components of a combination at one time point, other components at a different time point, that is, in a chronically staggered manner, preferably such that the combination shows more efficiency than the single compounds administered independently (especially showing synergism). Separate use (administration) preferably means administration of the components of the combination independently of each other at different time points, preferably meaning that the components (a) and (b) are administered such that no overlap of significant measurable blood levels of both compounds are present in an overlapping manner (at the same time).

Also combinations of two or more of sequential, separate and simultaneous administration are possible, preferably such that the combination component-drugs show a joint therapeutic effect that exceeds the effect found when the combination component-drugs are used independently at time intervals so large that no mutual effect on their therapeutic efficiency can be found, a synergistic effect being especially preferred.

The term "delay of progression" as used herein means administration of the combination to patients being in a pre-stage or in an early phase, of the first manifestation or a relapse of the disease to be treated, in which patients, e.g., a pre-form of the corresponding disease is diagnosed or which patients are in a condition, e.g., during a medical treatment or a condition resulting from an accident, under which it is likely that a corresponding disease will develop.

"Jointly therapeutically active" or "joint therapeutic effect" means that the compounds may be given separately (in a chronically staggered manner, especially a sequence-specific manner) in such time intervals that they preferably, in the warm-blooded animal, especially human, to be treated, still show a (preferably synergistic) interaction (joint therapeutic effect). Whether this is the case, can inter alia be determined by following the blood levels, showing that both compounds are present in the blood of the human to be treated at least during certain time intervals.

Additional Definitions

For convenience, the meaning of certain terms and phrases used in the specification, examples, and appended claims, are provided below. If there is an apparent discrepancy between the usage of a term in other parts of this specification and its definition provided in this document, the definition in this document shall prevail.

As used throughout this disclosure, articles such as "a" and "an" refer to one or more than one (at least one) of the grammatical object of the article.

RNAi Agents to Beta-Catenin

In one embodiment, the present disclosure pertains to a Beta-Catenin RNAi agent or other anti-sense nucleic acid complementary to a mRNA encoding the Beta-Catenin gene (or portion thereof), or a recombinant expression vector encoding encoding at least one strand of the siRNA (RNAi agent) or a composition comprising the antisense nucleic acid that can function as an RNAi agent as defined below.

As used herein, an "anti-sense" nucleic acid comprises a nucleotide sequence complementary to a "sense" nucleic acid encoding the Beta-Catenin protein (e.g., complementary to the coding strand of a double-stranded DNA, complementary to an mRNA or complementary to the coding strand of a Beta-Catenin gene).

As used herein, the term "RNAi agent to Beta-Catenin," "RNAi agent specific to Beta-Catenin," "iRNA agent to Beta-Catenin," "siRNA to Beta-Catenin", "Beta-Catenin siRNA" and the like refer to a siRNA (short inhibitory RNA), siRNA (short or small hairpin RNA), iRNA (interference RNA) agent, RNAi (RNA interference) agent, dsRNA (double-stranded RNA), microRNA, and the like, and refer to a composition which specifically targets, is specific to, and/or binds to a mRNA corresponding to the Beta-Catenin gene. As used herein, the term "antisense nucleic acid" or "composition comprising an anti-sense nucleic acid" and the like is broadly meant to encompass any composition comprising at least one nucleic acid strand which is anti-sense to its target; this includes, but is not limited to, any siRNA, shRNA, iRHA, dsRNA, microRNA, antisense oligonucleotide, and any other composition comprising an anti-sense nucleic acid.

As used herein, the terms "iRNA" and "RNAi" refers to an agent that contains RNA (or a derivative thereof), and which mediates the targeted cleavage of another RNA transcript via an RNA-induced silencing complex (RISC) pathway. In one embodiment, the RNAi agent is an oligonucleotide composition that activates the RISC complex/pathway. In another embodiment, the RNAi agent comprises an anti-sense strand sequence (anti-sense oligonucleotide). RNAi agents include, for example, siRNAs, dsRNAs and shRNAs. The RNAi agents can be wholly RNA, or can comprise a backbone or individual nucleotides which are not RNA, such as LNA, GNA, TNA, boranophosphate RNA, FANA, etc. Individual nucleotides can be replaced by DNA (e.g., the terminal UU, TT, or the like) or individual nucleotides at the 5' end or internally. However, in no case does the disclosure contemplate the RNAi agent comprising two strands which are completely DNA (e.g., a double-stranded DNA).

In one embodiment, the RNAi comprises a single strand. This single-stranded RNAi agent oligonucleotide or polynucleotide can comprise the sense or antisense strand, as described by Sioud 2005 J. Mol. Biol. 348:1079-1090, and references therein. Thus the disclosure encompasses RNAi agents with a single strand comprising either the sense or antisense strand of an RNAi agent described herein.

The RNAi agent(s) of the present disclosure target (e.g., bind to, anneal to, etc.) the Beta-Catenin mRNA. The use of the RNAi agent specific to Beta-Catenin results in a decrease of Beta-Catenin activity, level and/or expression, e.g., a "knock-down" or "knock-out" of the target gene or target sequence. Particularly, in one embodiment, in the case of a disease state characterized by over-expression or hyper-activity of Beta-Catenin, administration of a RNAi agent to Beta-Catenin knocks down the Beta-Catenin target enough to restore a normal level of Beta-Catenin activity.

In one embodiment, the RNAi comprises a single strand (such as an shRNA, as described herein). In other embodiments, the RNAi agent comprises a single strand because the sense and anti-sense strands are contiguous, connected by a loop, or otherwise linked.

In various embodiments, one or both strands are nicked.

In one embodiment, a single-stranded RNAi agent oligonucleotide or polynucleotide can comprise the sense and/or antisense strand. See, e.g., Sioud 2005 J. Mol. Biol. 348: 1079-1090, and references cited therein. Thus the present disclosure encompasses RNAi agents with a single strand comprising either the sense or antisense strand of a RNAi agent described herein.

RNAi agents that are particularly useful for this disclosure include those which can bind specifically to a region of the Beta-Catenin mRNA, and have one or more of the following qualities: binding in the coding segment of Beta-Catenin; binding at or near the junction of the 5' untranslated region and the start of the coding segment; binding at or near the translational start site of the mRNA; binding in the third exon of the Beta-Catenin gene; binding at or near junctions of exons and introns; little or no binding to the mRNAs of other genes (little or no "off-target effects"); binding to the Beta-Catenin mRNA in or near a region or regions that is not double-stranded or a stem region, e.g., in a loop or single-stranded portion; eliciting little or no immunogenicity; binding in a segment of the Beta-Catenin mRNA sequence which is conserved among various animal species (including human, mouse, rat, cynomolgus monkey, etc.), as the presence of a conserved sequence facilitates testing using various laboratory animals; binding to double-stranded region(s) of the mRNA; binding to an AT-rich region (e.g., at least about 50, 51, 52, 53, 54, 55, 56, 57, 58, 59, or 60% AT-rich); and/or lacking particular sequences known or suspected to decrease siRNA activity, e.g., the presence of a GG sequence at the 5' end, which may decrease separation of the double-stranded portion of the RNAi agent. In various embodiments, the RNAi agent specific to Beta-Catenin can be a double-stranded RNA having any one or more of these qualities.

The term "double-stranded RNA" or "dsRNA," as used herein, refers to a RNAi agent comprising a first and a second strand; e.g., a composition that includes an RNA molecule or complex of molecules having a hybridized duplex region (i.e., a region where the nucleotide bases from the first strand and the second strand are paired) that comprises two anti-parallel and substantially complementary nucleic acid strands, which will be referred to as having "sense" and "anti-sense" orientations with respect to a target RNA. The anti-sense strand, with respect to the mRNA target, is also called the "guide" strand, and the sense strand is also called the "passenger" strand. The passenger strand can include at least one or more of the following: one or more extra nucleotides (e.g., a bulge or 1 nt loop) compared to the other strand, a nick, a gap, etc., compared to the other strand. In various embodiments, the RNAi agent comprises a first strand and a second strand. In various embodiments, the first strand is the sense strand and the second strand is the anti-sense strand. In other embodiments, the first strand is the anti-sense strand and the second strand is the sense strand.

The duplex region can be of any length that permits specific degradation of a desired target RNA through a RISC pathway, but will typically range from 9 to 36 base pairs ("bp") in length, e.g., 15-30 base pairs in length. Considering a duplex between 9 and 36 base pairs, the duplex can be any length in this range, for example, 9, 10, 11, 12, 13, 14, 15, 16, 17, 18, 19, 20, 21, 22, 23, 24, 25, 26, 27, 28, 29, 30, 31, 32, 33, 34, 35, or 36 base pairs (bp) and any sub-range therebetween, including, but not limited to 15-30 base pairs, 15-26 base pairs, 15-23 base pairs, 15-22 base pairs, 15-21 base pairs, 15-20 base pairs, 15-19 base pairs, 15-18 base pairs, 15-17 base pairs, 18-30 base pairs, 18-26 base pairs, 18-23 base pairs, 18-22 base pairs, 18-21 base pairs, 18-20 base pairs, 19-30 base pairs, 19-26 base pairs, 19-23 base pairs, 19-22 base pairs, 19-21 base pairs, 19-20 base pairs, 19 base pairs, 20-30 base pairs, 20-26 base pairs, 20-25 base pairs, 20-24 base pairs, 20-23 base pairs, 20-22 base pairs, 20-21 base pairs, 20 basepairs, 21-30 base pairs, 21-26 base pairs, 21-25 base pairs, 21-24 base pairs, 21-23 base pairs, 21-22 base pairs, 21 base pairs, 22 base pairs, or 23 base pairs. dsRNAs generated in the cell by processing with Dicer and similar enzymes are generally in the range of 19-22 base pairs in length. One strand of the duplex region of a dsRNA comprises a sequence that is substantially complementary to a region of a target RNA. The two strands forming the duplex structure can be from a single RNA molecule having at least one self-complementary duplex region, or can be formed from two or more separate RNA molecules that hybridize to form the duplex. Where the duplex region is formed from two strands of a single molecule, the molecule can have a duplex region separated by a single-stranded chain of nucleotides (herein referred to as a "hairpin loop", e.g., such as found in a shRNA construct) between the 3'-end of one strand and the 5'-end of the respective other strand forming the duplex structure. The hairpin loop can comprise at least one unpaired nucleotide; in some embodiments the hairpin loop can comprise at least 3, at least 4, at least 5, at least 6, at least 7, at least 8, at least 9, at least 10, at least 20, at least 23 or more unpaired nucleotides. Where the two substantially complementary strands of a dsRNA are comprised by separate RNA molecules, those molecules need not, but can be covalently connected. Where the two strands are connected covalently by a hairpin loop, the construct is generally referred to herein and in the art as a "shRNA." Where the two strands are connected covalently by means other than a hairpin loop, the connecting structure is referred to as a "linker."

The terms "RNAi agent" and "siRNA" are also used herein to refer to a dsRNA as described above, useful for RNA interference.

In various embodiments of the present disclosure, the composition pertains to RNAi agents to Beta-Catenin comprising a sense strand comprising at least 15 contiguous nt with 0, 1, 2 or 3 mismatches from the sense strand, and/or an anti-sense strand comprising at least 15 contiguous nt with 0, 1, 2, or 3 mismatches from the anti-sense strand of any RNAi agent disclosed herein, particularly in Tables 1, 2, 3, 4, 5, 6, 7, 8 and/or 9, and modified and unmodified variants thereof.

RNAi Agents to Beta-Catenin Comprising Mismatches from the Disclosed Sequences

Various specific embodiments of a RNAi agent to Beta-Catenin are disclosed herein; example sequences are provided in Tables 1, 2 and 3. Specific embodiments of the present disclosure include RNAi agents which comprise sequences differing by 0, 1, 2, or 3 nt (nucleotides) or by [basepair(s)] (e.g., with 0, 1, 2 or 3 mismatches) from any of the RNAi agents listed in Tables 1, 2, 3, 4, 5, 6, 7, 8 and/or 9, and modified and unmodified variants thereof.

A mismatch is defined herein as a difference between the base sequence or length when two sequences are maximally aligned and compared. A mismatch is defined as a position wherein the base of one sequence does not match the base of the other sequence. Thus, a mismatch is counted, for example, if a position in one sequence has a particular base (e.g., A), and the corresponding position on the other sequence has a different base (e.g., G). Substitution of A, for example, with T, C, G or U would constitute a mismatch. Substitution of G with T, A, C or U would also constitute a mismatch. Substitution of C with T, G, A or U would also constitute a mismatch. Substitution of U with A, C or G would constitute a mismatch. Note, however, that on a given strand, a U can be replaced by T (either as RNA or, preferably, DNA, e.g., 2'-deoxy-thymidine); the replacement of a U with a T is not a mismatch, as either U or A can pair with A on the opposite strand. The RNAi agent can thus comprise some DNA bases, e.g., T, or a terminal TT or UU.

A mismatch is also counted, e.g., if a position in one sequence has a base (e.g., A), and the corresponding position on the other sequence has no base (e.g., that position is an abasic nucleotide, which comprises a phosphate-sugar backbone but no base). A single-stranded nick in either sequence (or in the sense or anti-sense strand) is not counted as mismatch. Thus, as a non-limiting example, no mismatch would be counted if one sequence comprises the sequence AG, but the other sequence comprises the sequence AG with a single-stranded nick between the A and the G. If one sequence comprises a C, and the other sequence comprises a modified C (e.g., 2'-modification) at the same position, no mismatch would be counted.

In addition, no mismatches are counted if modifications are made to the sugar, phosphate, or backbone of the RNAi agent without modifying the base. Thus, a sequence of UGGUGCUGACUAUCCAGUU (SEQ ID NO: 429) as an RNA and the same sequence as a PNA (peptide nucleic acid) have 0 mismatches from each other.

It is also noted that the sequences of the RNAi agents in Tables 1, 2, 3, 4, 5, 6, 7, 8 and/or 9 include sequences which comprise modifications, as detailed in Table 3. For example, one modified variant of the RNAi agent AD-18892 comprises strands of the sequences uGGuGcuGAcuAuccA-GuudTdT (SEQ ID NO: 6132) and AACUGGAuAGUcA-GcACcAdTdT (SEQ ID NO: 660). It is noted that dTdT (2'-deoxy-thymidine-5'-phosphate and 2'-deoxy-thymidine-5'-phosphate), or in some cases, TT or UU, is added as a cap or extension to both 3'-ends, but this cap or extension is not included in the calculation of the total number of mismatches. In addition, the sequence uGGuGcuGAcuAuccA-Guu (SEQ ID NO: 1) comprises modifications from the corresponding portion of the Beta-Catenin gene, or UGGUGCUGACUAUCCAGUU (SEQ ID NO: 4771). In this case, lowercase "c" represents 2'-O-methylcytidine-5'-phosphate, and lowercase "u" represents 2'-O-methyluridine-5'-phosphate. Uppercase "A", "C", "G" and "U" represent the un-modified adenosine-5'-phosphate, cytidine-5'-phosphate, guanosine-5'-phosphate, and uridine-5'-phosphate, respectively. The substitution of modified c for unmodified C does not count as a mismatch in numbering the 0, 1, 2, or 3 mismatches between sequences. This is true of all sequences in Tables 1, 2, 3, 4, 5, 6, 7, 8 and/or 9. Thus, an equal number of mismatches would be calculated (a) between a test sequence and a modified sequence (e.g., that of AD-18892 or any other sequence in Tables 1, 2, 3, 4, 5, 6, 7, 8 and/or 9), and (b) between the same test sequence and the corresponding unmodified sequence from the Beta-Catenin gene (e.g., the portion of the Beta-Catenin gene corresponding to AD-18892 or any other sequence in Table 1), and (c) between a modified sequence and a differently modified sequence which have the same base sequence.

In one particular embodiment, the present disclosure comprises a RNAi agent comprising a anti-sense strand comprising at least 15 or 19 contiguous nucleotides differing by 0, 1, 2, or 3 nt from the sequence of the anti-sense strand of: any of the RNAi agents listed in Tables 1, 2, 3, 4, 5, 6, 7, 8 and/or 9, and modified and unmodified variants thereof.

It is noted that the present disclosure pertains to "modified and unmodified variants" of the disclosed sequences.

An "unmodified variant" (also known as a "generic") of a particular sequence is the corresponding portion of Beta-Catenin without any modifications. For example, a modified variant (or "generic") of AD-18892 comprises a strand of the sequence uGGuGcuGAcuAuccAGuudTdT (SEQ ID NO: 6132); the corresponding "unmodified variant" is the corresponding portion of the wild-type Beta-Catenin sequence without modifications or terminal dTdT, namely, UGGUGCUGACUAUCCAGUU (SEQ ID NO: 6140), as described above. The "unmodified variants" of the sequences of Tables 1, 2, 3, 4, 5, 6, 7, 8 and/or 9 have the identical sequence, without base modifications or terminal dTdT. A given sequence and an "unmodified variant" of it differ by 0 nt (and have no mismatches).

A "modified variant" of a particular sequence comprises one or more (or one or more fewer) modifications to the backbone, sugar, phosphate or base, but do not have any base substitutions (e.g., G for C, or A for G); thus a given sequence and a modified variant thereof differ by 0 nt (and have no mismatches). A modified variant of the sequence of uGGuGcuGAcuAuccAGuu (SEQ ID NO: 1) is, as a non-limiting example, UGGuGcuGAcUAuccAGuu (SEQ ID NO: 6089). As another example, a given sequence [e.g., uGGuGcuGAcuAuccAGuu (SEQ ID NO: 1)] as a RNA and the same sequence as a PNA are modified variants of each other and differ by 0 nt (and have no mismatches). Similarly, the same sequence (with no base substitutions) as a locked nucleic acid (LNA), Morpholino, threose nucleic acid (TNA), or glycol nucleic acid (GNA) or FANA would be a modified variant which has 0 mismatches.

As detailed below, substituting a single nucleotide at a given position with a modified version of the same nucleotide would produce a modified variant (with 0 mismatches).

In another particular embodiment, the RNAi agent comprises a sense strand comprising at least 15 contiguous nucleotides differing by 0, 1, 2, or 3 nt from the sense strand of any of the RNAi agents listed in Tables 1, 2, 3, 4, 5, 6, 7, 8 and/or 9, and modified and unmodified variants thereof.

RNAi agents to Beta-Catenin of the present disclosure can be used in RNA interference.

Modifications of RNAi Agent Sequences

The present disclosure encompasses both unmodified sequences and example modified sequences, such as those disclosed in Tables 1, 2 and 3.

The present disclosure further encompasses any other modification of a disclosed sequence (e.g., a modified variant).

For example, the disclosure encompasses a RNAi agent with a substitution of a single nucleotide at a given position with a modified version of the same nucleotide. Thus a nucleotide (A, G, C or U) can be replaced by the corresponding 5-fluorouracil, 5-bromouracil, 5-chlorouracil, 5-iodouracil, hypoxanthine, xantine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, or 2,6-diaminopurine.

Additional modified variants include the addition of any other moiety (e.g., a radiolabel or other tag or conjugate) to the RNAi agent; provided that the base sequence is identical, the addition of other moieties produces a "modified variant" (with no mismatches).

Various sets of modifications can be used. These include the following formats, which are used in various screens disclosed herein.
A22 a All UA as 2'-OMe-U A and all CA as 2'-OMe-C A
S26 a All U as 2'-OMe-U and all C as 2'-OMe-C
All 3' overhangs as 2'-OMe-U 2'-OMe-U
A25S27
A25 a wt RNA
S27 a wt RNA
All 3' overhangs as 2'-OMe-U 2'-OMe-U
A48S26
A48 a All UA as 2'-OMe-U A and all CA as 2'-OMe-C A, first 5'-N is DNA
S26 a All U as 2'-OMe-U and all C as 2'-OMe-C
All 3' overhangs as 2'-OMe-U 2'-OMe-U
A51S26
A51 a All U as 2'-OMe-U and all C as 2'-OMe-C, except pos. 1, 2 and 14
S26 a All U as 2'-OMe-U and all C as 2'-OMe-C
All 3' overhangs as 2'-OMe-U 2'-OMe-U
A52S36
A52 a 2'-OMe-N at pos. 3, 7, 10 and 13, 2'-MOE-N at pos. 18 and 19
S36 a 2'-OMe-N at pos. 4, 8, 12 and 15, 2'-MOE-N at pos. 1, 2, 18 and 19
All 3' overhangs as 2'-OMe-U 2'-OMe-U
A53S37
A53 a 2'-MOE-N at pos. 3, 7, 10, 13, 18 and 19
S37 a 2'-MOE-N at pos. 1, 2, 4, 8, 12, 15, 18 and 19
All 3' overhangs as 2'-OMe-U 2'-OMe-U
A54S36
A54 a 2'-OMe-N at pos. 3, 7, 10 and 13, 2'-MOE-N at pos. 18 and 19, DNA at pos. 1
S36 a 2'-OMe-N at pos. 4, 8, 12 and 15, 2'-MOE-N at pos. 1, 2, 18 and 19
All 3' overhangs as 2'-OMe-U 2'-OMe-U
A55S36
A55 a 2'-OMe-N at pos. 3, 7, 10 and 13, 2'-MOE-N at pos. 18 and 19,
2'-F-N at pos. 1
S36 a 2'-OMe-N at pos. 4, 8, 12 and 15, 2'-MOE-N at pos. 1, 2, 18 and 19
All 3' overhangs as 2'-OMe-U 2'-OMe-U In addition to these modifications and patterns (e.g, formats) for modifications, other modifications or sets of modifications of the sequences provided can be generated using common knowledge of nucleic acid modification.

RNA Interference

RNA interference (RNAi) is a post-transcriptional, targeted gene-silencing technique that uses double-stranded RNA (dsRNA) to degrade messenger RNA (mRNA) containing the same sequence as the dsRNA. The process of RNAi occurs when ribonuclease III (Dicer) cleaves the longer dsRNA into shorter fragments called siRNAs. siRNAs (small interfering RNAs) produced by Dicer are typically about 21 to 23 nucleotides long and comprise about 19 base pair duplexes (though artificial siRNAs or RNAi agents can be shorter, and/or blunt-ended, and/or comprises one or more endcaps). The smaller RNA segments then mediate the degradation of the target mRNA. Dicer has also been implicated in the excision of 21- and 22-nucleotide small temporal RNAs (stRNAs) from precursor RNA of conserved structure that are implicated in translational control. Hutvagner et al. 2001 Science 293: 834. The RNAi response also features an endonuclease complex, commonly referred to as an RNA-induced silencing complex (RISC), which mediates cleavage of single-stranded mRNA complementary to the anti-sense strand of the RNAi agent. Cleavage of the target RNA takes place in the middle of the region complementary to the anti-sense strand of the siRNA duplex.

In one aspect, an RNA interference agent includes a single-stranded RNA that interacts with a target RNA sequence to direct the cleavage of the target RNA. Without wishing to be bound by theory, long double-stranded RNA introduced into plants and invertebrate cells is broken down into siRNA by a Type III endonuclease known as Dicer. Sharp et al. 2001 Genes Dev. 15:485. Dicer, a ribonuclease-III-like enzyme, processes the dsRNA into 19-23 base pair short interfering RNAs with characteristic two base 3' overhangs. Bernstein et al. 2001 Nature 409:363. The siRNAs are then incorporated into an RNA-induced silencing complex (RISC) where one or more helicases unwind the siRNA duplex, enabling one of the now-unpaired siRNA strands to act as a "guide" strand to guide target recognition. Nykanen et al. 2001 Cell 107:309. Upon binding of the anti-sense guide strand to the appropriate target mRNA, one or more endonucleases within the RISC cleaves the target to induce silencing. Elbashir et al. 2001 Genes Dev. 15:188. Thus, in one aspect the present disclosure relates to a single-stranded RNA that promotes the formation of a RISC complex to effect silencing of the target gene.

RNA interference has also been studied in a variety of systems. Work in *Drosophila* embryonic lysates (Elbashir et al. 2001 EMBO J. 20: 6877 and Tuschl et al. International PCT Publication No. WO 01/75164) has revealed certain requirements for siRNA length, structure, chemical composition, and sequence that are essential to mediate efficient RNAi activity in a variety of systems, including especially mammals. These studies have shown that 21-nucleotide siRNA duplexes are most active when containing 3'-terminal dinucleotide overhangs. Substitution of the 3'-terminal siRNA overhang nucleotides with 2'-deoxy nucleotides (2'-H) was tolerated. In addition, a 5'-phosphate on the target-complementary strand of a siRNA duplex is usually required for siRNA activity. Most importantly for therapeutic uses, siRNA duplexes shorter than 50 bp or so do not activate the interferon response in mammalian cells. See, e.g., Tuschl et al., WO 01/752164.

Others have reported on various RNAi and gene-silencing systems. For example, Churikov et al. International PCT Publication No. WO 01/42443 describe certain methods for modifying genetic characteristics of an organism using certain dsRNAs. Reed et al. International PCT Publication No. WO 01/68836 describe certain methods for gene silencing in plants. Honer et al. International PCT Publication No. WO 01/70944 describe certain methods of drug screening using transgenic nematodes as Parkinson's Disease models using certain dsRNAs. Arndt et al. International PCT Publication No. WO 01/92513 describe certain methods for mediating gene suppression by using factors that enhance RNAi. Tuschl et al. International PCT Publication No. WO 02/44321 describe certain synthetic siRNA constructs. Pachuk et al. International PCT Publication No. WO 00/63364, and Satishchandran et al. International PCT Publication No. WO 01/04313 describe certain methods and compositions for inhibiting the function of certain polynucleotide sequences using certain long (over 250 bp), vector expressed dsRNAs. Kreutzer et al. International PCT Publications Nos. WO 02/055692, WO 02/055693, and EP 1144623 B1 describes certain methods for inhibiting gene expression using dsRNA. Graham et al. International PCT Publications Nos. WO 99/49029 and WO 01/70949, and AU 4037501 describe certain vector expressed siRNA molecules. Fire et al. U.S. Pat. No. 6,506,559 describe certain methods for inhibiting gene expression in vitro using certain long dsRNA (299 bp-1033 bp) constructs that mediate RNAi. Martinez et al. 2002 Cell, 110, 563-574 describe certain single-stranded siRNA constructs, including certain 5'-phosphorylated single-stranded siRNAs that mediate RNA interference in HeLa cells. Harborth et al. 2003 Anti-sense & Nucleic Acid Drug Development 13: 83-105 describe certain chemically and structurally modified siRNA molecules. Chiu and Rana 2003 RNA 9: 1034-1048 describe certain chemically and structurally modified siRNA molecules. Woolf et al. International PCT Publication Nos. WO 03/064626 and WO 03/064625 describe certain chemically modified dsRNA constructs.

Kits for RNAi synthesis are commercially available, e.g., from New England Biolabs and Ambion.

The RNAi agent(s) of the present disclosure target (e.g., bind to, anneal to, etc.) the Beta-Catenin mRNA. The use of the RNAi agent to Beta-Catenin results in a decrease of Beta-Catenin activity, level and/or expression, e.g., a "knock-down" or "knock-out" of the target gene or target sequence. Particularly, in one embodiment, in the case of a disease state characterized by over-expression or hyperactivity or improper cellular compartmentalization of Beta-Catenin, administration of a RNAi agent to Beta-Catenin knocks down the Beta-Catenin target enough to restore a normal level of Beta-Catenin activity.

A suitable RNAi agent can be selected by any process known in the art or conceivable by one of ordinary skill in the art. For example, the selection criteria can include one or more of the following steps: initial analysis of the Beta-Catenin gene sequence and design of RNAi agents; this design can take into consideration sequence similarity across species (human, cynomolgus, mouse, etc.) and dissimilarity to other (non-Beta-Catenin) genes; screening of RNAi agents in vitro (e.g., at 10 nM in HeLa cells); determination of EC50 in HeLa cells; determination of viability of cells treated with RNAi agents, including insensitive cells which do not require Beta-Catenin for survival (e.g., NCI-H28 or RKO), or sensitive cells, which do require Beta-Catenin for survival (e.g., LoVo, DLD-1, LS411N, or SW403); testing with human PBMC (peripheral blood mononuclear cells), e.g., to test levels of TNF-alpha to estimate immunogenicity, wherein immunostimulatory sequences are less desired; testing in human whole blood assay, wherein fresh human blood is treated with an RNAi agent and cytokine/chemokine levels are determined [e.g., TNF-alpha (tumor necrosis factor-alpha) and/or MCP1 (monocyte chemotactic protein 1)], wherein Immunostimulatory sequences are less desired; determination of gene knockdown in vivo using Hep3B subcutaneous tumors in test animals; Beta-Catenin target gene modulation analysis, e.g., using a pharmacodynamic (PD) marker, for example, other components of the Wnt/Beta-Catenin pathway, wherein Beta-Catenin knockdown leads to a dose-dependent reduction of abundance of those components; and optimization of specific modifications of the RNAi agents.

The dsRNA molecules (RNAi agents) described herein are thus useful in RNA interference of the Beta-Catenin gene.

Features of a RNAi Agent: Sense Strand, Anti-Sense Strand and (Optional) Overhangs In various embodiments, the RNAi agents comprise a first strand and a second strand, e.g., a sense strand and an anti-sense strand. Optionally, one or both ends of the duplex contain unpaired nucleotides referred to herein as "overhangs".

The term "anti-sense strand" refers to the strand of a RNAi agent which includes a region that is substantially complementary to a target sequence. As used herein, the term "region of complementarity" refers to the region on the anti-sense strand that is substantially complementary to a sequence, for example a target sequence, as defined herein. Where the region of complementarity is not fully complementary to the target sequence, the mismatches may be in the internal or terminal regions of the molecule. Generally, the most tolerated mismatches are in the terminal regions, e.g., within 5, 4, 3, or 2 nucleotides of the 5' and/or 3' terminus.

The term "sense strand," as used herein, refers to the strand of a RNAi agent that includes a region that is substantially complementary to a region of the anti-sense strand as that term is defined herein.

The sequence of a gene may vary from individual to individual, especially at wobble positions within the coding segment, or in the untranslated region; individuals may also differ from each other in coding sequence, resulting in additional differences in mRNA. The sequence of the sense and anti-sense strands of the RNAi agent can thus be designed to correspond to that of an individual patient, if and where needed. RNAi agents can also be modified in sequence to reduce immunogenicity, binding to undesired mRNAs (e.g., "off-target effects") or to increase stability in the blood. These sequence variants are independent of chemical modification of the bases or 5' or 3' or other end-caps of the RNAi agents. In the case of Beta-Catenin, three human transcripts have been published: NP_001091679.1; NP_001091680.1; and NP_001895.1. Variants between these can be used to design RNAi agents to Beta-Catenin.

The RNAi agents can comprise overhang(s), blunt end(s) and/or endcap(s). The RNAi agents can have overhangs of 0, 1, or 2 overhangs; in the case of 0 nt overhangs, they are blunt-ended. A RNAi agent can have 0, 1 or 2 blunt ends. In a "blunt-ended RNAi agent" both strands terminate in a base-pair; thus a blunt-ended molecule lacks either 3' or 5' single-stranded nucleotide overhangs.

As used herein, the term "overhang" or "nucleotide overhang" refer to at least one unpaired nucleotide that protrudes from end of at least one of the two strands of the duplex structure of a RNAi agent. For example, when a 3'-end of one strand of a dsRNA extends beyond the 5'-end of the other strand, or vice versa, there is an overhang. A dsRNA can comprise an overhang of at least one nucleotide; alternatively the overhang can comprise at least two nucleotides, at least three nucleotides, at least four nucleotides, at least five nucleotides or more. An overhang can comprise or consist of a nucleotide/nucleoside analog, including a deoxynucleotide/nucleoside. The overhang(s) may be on the sense strand, the anti-sense strand or any combination thereof. Furthermore, the nucleotide(s) of an overhang can be present on the 5' end, 3' end or both ends of either an anti-sense or sense strand of a dsRNA.

The RNAi agent can also optionally comprise a cap. The term "Cap" and the like include a chemical moiety attached to the end of a double-stranded nucleotide duplex, but is used herein to exclude a chemical moiety that is a nucleotide or nucleoside. A "3' Cap" is attached at the 3' end of a nucleotide or oligonucleotide and protects the molecule, e.g., from nucleases, such as those in blood serum or intestinal fluid. A useful 3' cap will increase stability (e.g., reduce degradation, for example, by nucleases) and also still allow RNAi activity. Various 3' end caps are as disclosed in, for example, WO 2005/021749 and WO 2007/128477; and U.S. Pat. Nos. 8,084,600 and 8,097,716. A "5' cap" is attached at the 5' end of a nucleotide or oligonucleotide. A cap should not interfere (or unduly interfere) with RNAi activity.

The present disclosure thus contemplates a RNAi agent specific to Beta-Catenin comprising an anti-sense strand. In a more specific embodiment, the present disclosure contemplates a RNAi agent specific to Beta-Catenin comprising a first and a second strand, e.g., a sense strand and an anti-sense strand (which may optionally be contiguous or connected via a linker or loop), or an anti-sense strand and a sense strand (which may optionally be contiguous or connected via a linker or loop), which together comprise a double-stranded or complementary region, and can also optionally comprise one or two overhangs, and/or one or two caps, and/or modifications of the sugar, phosphate or base, and/or additional moieties. The RNAi agent is used to induce RNA interference of the Beta-Catenin gene.

Target and Complementary Sequences

The RNAi agents of the present disclosure target (e.g., specifically bind to, anneal to, etc.) the mRNA encoding the gene Beta-Catenin. The use of the RNAi agent specific to Beta-Catenin results in a decrease of Beta-Catenin activity, level and/or expression and/or cellular distribution/compartmentalization, e.g., a "knock-down" or "knock-out" of the target gene or target sequence. Particularly in one embodiment, in the case of a disease state characterized by over-expression or hyper-activity of Beta-Catenin, administration of a RNAi agent to Beta-Catenin knocks down the Beta-Catenin gene enough to restore a normal level, abundance or cellular distribution of Beta-Catenin activity.

As used herein, "target sequence" or "target gene" refer to a contiguous portion of the nucleotide sequence of an mRNA molecule formed during the transcription of a gene, e.g., a Beta-Catenin gene, including mRNA that is a product of RNA processing of a primary transcription product. The target portion of the sequence will be at least long enough to serve as a substrate for iRNA-directed cleavage at or near that portion. For example, the target sequence will generally be from 9-36 nucleotides (nt) in length, e.g., 15-30 nucleotides in length, including all sub-ranges therebetween. As non-limiting examples, the target sequence can be from 15-30 nucleotides, 15-26 nucleotides, 15-23 nucleotides, 15-22 nucleotides, 15-21 nucleotides, 15-20 nucleotides, 15-19 nucleotides, 15-18 nucleotides, 15-17 nucleotides, 18-30 nucleotides, 18-26 nucleotides, 18-23 nucleotides, 18-22 nucleotides, 18-21 nucleotides, 18-20 nucleotides, 19-30 nucleotides, 19-26 nucleotides, 19-23 nucleotides, 19-22 nucleotides, 19-21 nucleotides, 19-20 nucleotides, 19 nucleotides, 20-30 nucleotides, 20-26 nucleotides, 20-25 nucleotides, 20-24 nucleotides, 20-23 nucleotides, 20-22 nucleotides, 20-21 nucleotides, 20 nucleotides, 21-30 nucleotides, 21-26 nucleotides, 21-25 nucleotides, 21-24 nucleotides, 21-23 nucleotides, or 21-22 nucleotides, 21 nucleotides, 22 nucleotides, or 23 nucleotides. The sense and anti-sense strands of the RNAi comprise a sequence complementary to that of the target nucleic acid, Beta-Catenin.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary" refers to the ability of an oligonucleotide or polynucleotide comprising a first nucleotide sequence to hybridize and form a duplex structure under certain conditions with an oligonucleotide or polynucleotide comprising a second nucleotide sequence. Such conditions can, for example, be stringent, e.g., 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Complementary sequences within a RNAi agent, e.g., within a dsRNA as described herein, include base-paired oligonucleotides or polynucleotides comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they may form one or more, but generally not more than 5, 4, 3 or 2 mismatched base pairs upon hybridization for a duplex up to 30 base pairs, while retaining the ability to hybridize under the conditions most relevant to their ultimate application, e g, inhibition of gene expression via a RISC pathway. However, where two oligonucleotides are designed to form, upon hybridization, one or more single-stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes described herein. The term "overhang" describes an unpaired nucleotide at the 3' or 5' end of a double-stranded nucleotide duplex, as described above. In one embodiment, the overhang is 1 to 4 nt long and is on the 3' end.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but are not limited to, G:U Wobble or Hoogstein base pairing.

The terms "complementary," "fully complementary" and "substantially complementary" herein may furthermore be used with respect to the base matching between the sense strand and the anti-sense strand of a dsRNA, or between the anti-sense strand of a RNAi agent and a target sequence, as will be understood from the context of their use. The RNAi agent of the present disclosure can comprise a sequence which is complementary to the sequence of a target sequence (DNA) which is disclosed herein. For example, if the target sequence disclosed is DNA, the RNAi agent can comprise a strand which is complementary to it (anti-parallel and having a sequence of bases which hydrogen bonds to the sequence of the target) and which is, for example, RNA, or RNA with a small number of DNA substitutions, or an alternative backbone such as FANA, PNA, GNA, TNA, boranophosphate or LNA, or RNA with a small number of substitutions which are FANA, PNA, GNA, TNA, boranophosphate or LNA, etc.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding Beta-Catenin). For example, a polynucleotide is complementary to at least a part of a Beta-Catenin mRNA if the sequence is substantially complementary to a non-interrupted portion of an mRNA encoding Beta-Catenin.

Thus, the RNAi agent of the present disclosure is complimentary or substantially complimentary to a target sequence in the mRNA corresponding to the target gene Beta-Catenin and is double-stranded, comprising a sense and an anti-sense strand (which can be contiguous, linked via a loop, or otherwise joined), where the double-stranded region an be 9 to 36 bp long (particularly for example, 19 to 22 or 19 to 23 bp long), and can furthermore optionally comprise a 3' or 5' overhang, and the RNAi agent can furthermore comprise a 3' cap. The RNAi agent mediates RNA interference, down-regulating or inhibiting the level, expression and/or activity of Beta-Catenin, and/or establishing or re-establishing an approximately normal level of Beta-Catenin and/or Beta-Catenin activity, or other biological function related to Beta-Catenin.

Double-Stranded RNA

The term "double-stranded RNA" or "dsRNA," as used herein, refers to an RNAi agent comprising a first and a second strand; e.g., a composition that includes an RNA molecule or complex of molecules having a hybridized duplex region that comprises two anti-parallel and substantially complementary nucleic acid strands, which will be referred to as having "sense" and "antisense" orientations with respect to a target RNA. The antisense strand, with respect to the mRNA target, is also called the "guide" strand, and the sense strand is also called the "passenger" strand. The passenger strand can include at least one or more of the following: one or more extra nucleotides (e.g., a bulge or 1 nt loop) compared to the other strand, a nick, a gap, etc., compared to the other strand. In various embodiments, the first strand is the sense strand and the second strand is the anti-sense strand. In other embodiments, the first strand is the anti-sense strand, and the second strand is the sense strand.

The duplex region can be of any length that permits specific degradation of a desired target RNA through a RISC pathway, but will typically range from 9 to 36 base pairs ("bp") in length, e.g., 15-30 base pairs in length. Considering a duplex between 9 and 36 base pairs, the duplex can be any length in this range, for example, 9, 10, 11, 12, 13, 14, 15, 16, 17, 18, 19, 20, 21, 22, 23, 24, 25, 26, 27, 28, 29, 30, 31, 32, 33, 34, 35, or 36 bp and any sub-range therebetween, including, but not limited to 15-30 base pairs, 15-26 bp, 15-23 bp, 15-22 bp, 15-21 bp, 15-20 bp, 15-19 bp, 15-18 bp, 15-17 bp, 18-30 bp, 18-26 bp, 18-23 bp, 18-22 bp, 18-21 bp, 18-20 bp, 19-30 bp, 19-26 bp, 19-23 bp, 19-22 bp, 19-21 bp, 19-20 bp, 19 bp, 20-30 bp, 20-26 bp, 20-25 bp, 20-24 bp, 20-23 bp, 20-22 bp, 20-21 bp, 20 bp, 21-30 bp, 21-26 bp, 21-25 bp, 21-24 bp, 21-23 bp, 21-22 bp, 21 bp, 22 bp, or 23 bp. The dsRNAs generated in the cell by processing with Dicer and similar enzymes are generally in the range of about 19 to about 22 base pairs in length. One strand of the duplex region of a dsRNA comprises a sequence that is substantially complementary to a region of a target RNA. The two strands forming the duplex structure can be from a single RNA molecule having at least one self-complementary duplex region, or can be formed from two or more separate RNA molecules that hybridize to form the duplex. Where the duplex region is formed from two self-complementary regions of a single molecule, the molecule can have a duplex region separated by a single stranded chain of nucleotides (herein referred to as a "hairpin loop", e.g., such as found in an shRNA construct) between the 3'-end of one strand and the 5'-end of the respective other strand forming the duplex structure. The hairpin loop can comprise at least one unpaired nucleotide; in some embodiments the hairpin loop can comprise at least 3, at least 4, at least 5, at least 6, at least 7, at least 8, at least 9, at least 10, at least 20, at least 23 or more unpaired nucleotides. Where the two substantially complementary strands of a dsRNA are comprised by separate RNA molecules, those molecules need not, but can be covalently connected. Where the two strands are connected covalently by a hairpin loop, the construct is generally referred to herein and in the art as a "shRNA". Where the two strands are connected covalently by means other than a hairpin loop, the connecting structure is referred to as a "linker." The term "siRNA" is also used herein to refer to a dsRNA as described above.

RNAi Agents Lowering or Normalizing Beta-Catenin Level, Expression, Cellular Distribution, and/or Activity Example RNAi agents for targeting Beta-Catenin include those which bind to a mRNA corresponding to the Beta-Catenin gene provided herein. Example RNAi agents to Beta-Catenin are provided in Tables 1, 2, 3, 4, 5, 6, 7, 8 and/or 9.

Any method known in the art can be use to measure changes in Beta-Catenin activity, level, cellular distribution (e.g., localization to the membrane but not the cytoplasm or nucleus) and/or expression induced by a Beta-Catenin RNAi agent. Measurements can be performed at multiple timepoints, prior to, during and after administration of the RNAi agent, to determine the effect of the RNAi agent.

The RNAi agents of the present disclosure silence, inhibit the expression of, down-regulate the expression of, and/or suppress the expression of the Beta-Catenin gene, such that an approximately normal level of Beta-Catenin activity, expression and/or level and/or distribution in various cellular compartments is achieved.

In addition, in various embodiments, depending on the disease condition and biological context, it is acceptable to use the RNAi agents of the present disclosure to establish a level of Beta-Catenin expression, activity and/or level which is below the normal level, or above the normal level.

Types of RNAi Agents and Modification Thereof

The use of RNAi agents or compositions comprising an anti-sense nucleic acid to down-modulate the expression of a particular protein in a cell is well known in the art. A RNAi agent comprises a sequence complementary to, and is capable of hydrogen binding to, the coding strand of another nucleic acid (e.g., an mRNA). Thus, in various embodiments, the RNAi agents of the present disclosure encompass any RNAi agents which target (e.g., are complementary to, capable of specific hydrogen binding to, etc.) any sequences presented herein, e.g., in Tables 1, 2, 3, 4, 5, 6, 7, 8 and/or 9.

Anti-sense sequences complementary to an mRNA can be complementary to the coding region, the 5' or 3' untranslated region of the mRNA, and/or a region bridging the coding and untranslated regions, and/or portions thereof. Furthermore, a RNAi agent can be complementary to a regulatory region of the gene encoding the mRNA, for instance a transcription or translation initiation sequence or regulatory element. Particularly, a RNAi agent or any portion thereof can be complementary to a region preceding or spanning the initiation codon on the coding strand or in the 3' untranslated region of an mRNA.

RNAi agent molecules can be designed according to the rules of Watson and Crick base pairing. The RNAi agent can be complementary to the entire coding region of Beta-Catenin mRNA, but more particularly is an oligonucleotide which is anti-sense to only a portion of the coding or non-coding region of Beta-Catenin mRNA. For example, the anti-sense oligonucleotide can be complementary to the region surrounding the translation start site of Beta-Catenin mRNA. An anti-sense oligonucleotide can be, for example, about 5, 10, 15, 19, 20, 21, 22, 23, 24, 25, 30, 35, 40, 45 or 50 nucleotides in length.

RNAi agent may have modifications internally, and/or at one or both ends. The modifications at the ends can help stabilize the RNAi agent, protecting it from degradation by nucleases in the blood.

The RNAi agents can also optionally be designed to anneal to known or predicted exposed and/or single-stranded regions of the mRNA (e.g., loops).

A RNAi agent can be constructed using chemical synthesis and enzymatic ligation reactions using procedures known in the art. For example, a RNAi agent can be chemically synthesized using naturally-occurring nucleotides or variously modified nucleotides designed to decrease off-target effects, and/or increase the biological stability of the molecules or to increase the physical stability of the duplex formed between the anti-sense and sense nucleic acids, e.g., phosphorothioate derivatives and acridine substituted nucleotides can be used.

"G," "C," "A," "T" and "U" each generally stand for a nucleotide that contains guanine, cytosine, adenine, thymidine and uracil as a base, respectively. However, the term "ribonucleotide" or "nucleotide" can also refer to a modified nucleotide or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of dsRNA featured in the present disclosure by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the present disclosure.

The skilled artisan will recognize that the term "RNA molecule" or "ribonucleic acid molecule" encompasses not only RNA molecules as expressed or found in nature (i.e., are naturally occurring), but also non-naturally-occurring analogs and derivatives of RNA comprising one or more ribonucleotide/ribonucleoside analogs or derivatives as described herein or as known in the art. Strictly speaking, a "ribonucleoside" includes a nucleoside base and a ribose sugar, and a "ribonucleotide" is a ribonucleoside with one, two or three phosphate moieties. However, the terms "ribonucleoside" and "ribonucleotide" can be considered to be equivalent as used herein. The RNA can be modified in the nucleobase structure or in the ribose-phosphate backbone structure, e.g., as described herein below. However, the molecules comprising ribonucleoside analogs or derivatives must retain the ability to form a duplex. As non-limiting examples, an RNA molecule can also include at least one modified ribonucleoside, including but not limited to a 2'-O-methyl modified nucleotide, a nucleoside comprising a 5' phosphorothioate group, a terminal nucleoside linked to a cholesteryl derivative or dodecanoic acid bisdecylamide group, a locked nucleoside, an abasic nucleoside, a 2'-deoxy-2'-fluoro modified nucleoside, a 2'-amino-modified nucleoside, 2'-alkyl-modified nucleoside, morpholino nucleoside, an unlocked ribonucleotide (e.g., an acyclic nucleotide monomer, as described in WO 2008/147824), a phosphoramidate or a non-natural base comprising nucleoside, or any combination thereof. Alternatively, an RNA molecule can comprise at least two modified ribonucleosides, at least 3, at least 4, at least 5, at least 6, at least 7, at least 8, at least 9, at least 10, at least 15, at least 20 or more, up to the entire length of the dsRNA molecule. The modifications need not be the same for each of such a plurality of modified ribonucleosides in an RNA molecule. In one embodiment, modified RNAs contemplated for use in methods and compositions described herein are peptide nucleic acids (PNAs) that have the ability to form the required duplex structure and that permit or mediate the specific degradation of a target RNA via a RISC pathway. In some cases, a RNA molecule can include a terminal dinucleotide (e.g., TT) which is DNA, and/or a small number of internal (e.g., base-pairing) DNA bases (e.g., fewer than the number of RNA bases), for example, a T substituting a U.

Examples of modified nucleotides which can be used to generate the RNAi agent include 5-fluorouracil, 5-bromouracil, 5-chlorouracil, 5-iodouracil, hypoxanthine, xantine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine.

A "modified variant" of a sequence disclosed herein includes any variant comprising the same sequence, but with a modification in the base, sugar, phosphate or backbone (but not a base substitution, e.g., A for G, or C for U). Thus, a modified variant can comprise any modified nucleotide described above (e.g., 5-fluorouracil, 5-bromouracil, 5-chlorouracil, 5-iodouracil, hypoxanthine, xantine, 4-acetylcytosine, 5-(carboxyhydroxylmethyl) uracil, etc.). When a base is replaced by a corresponding modified base (e.g., A for modified A), these modified nucleotides do not constitute a mismatch or base difference. Thus a given sequence with a U at a particular position and a modified variant comprising a 5-fluorouracil, 5-bromouracil, 5-chlorouracil, or 5-iodouracil at the same sequence would differ by 0 nt (or have no mismatches); however, a given sequence with a C at a particular position and a different sequence with a 5-fluorouracil (wherein the two sequences are otherwise identical) would differ by 1 nt (1 mismatch).

In one embodiment, the present disclosure encompasses any modified variant of any RNAi agent disclosed herein. The modified variant contains the same sequence, but can be modified to contain modifications in the phosphate, sugar, base, nucleotide, etc. For example, the modified variant can contain one or more of the modified nucleotides listed herein, for example a C replaced by a 2'-modified C (such sequences would differ by 0 mismatches).

In one aspect, a modified ribonucleoside includes a deoxyribonucleoside. In such an instance, a RNAi agent can comprise one or more deoxynucleosides, including, for example, a deoxynucleoside overhang(s), or one or more deoxynucleosides within the double-stranded portion of a dsRNA. However, it is self-evident that under no circumstances is a double-stranded DNA molecule encompassed by the term "RNAi agent."

Replacing the 3'-terminal nucleotide overhanging segments of a 21-mer RNAi agent duplex having two-nucleotide 3'-overhangs with deoxyribonucleotides does not have an adverse effect on RNAi activity. Replacing up to four nucleotides on each end of the RNAi agent with deoxyribonucleotides has been well tolerated, whereas complete substitution with deoxyribonucleotides results in no RNAi activity. International PCT Publication No. WO 00/44914, and Beach et al. International PCT Publication No. WO 01/68836 preliminarily suggest that siRNA may include modifications to either the phosphate-sugar backbone or the nucleoside to include at least one of a nitrogen or sulfur heteroatom. Kreutzer et al. Canadian Patent Application No. 2,359,180, also describe certain chemical modifications for use in dsRNA constructs in order to counteract activation of double-stranded RNA-dependent protein kinase PKR, specifically 2'-amino or 2'-O-methyl nucleotides, and nucleotides containing a 2'-O or 4'-C methylene bridge. Additional 3'-terminal nucleotide overhangs include dT (deoxythimidine), 2'-O,4'-C-ethylene thymidine (eT), and 2-hydroxyethyl phosphate (hp).

Parrish et al. 2000 Molecular Cell 6: 1077-1087 tested certain chemical modifications targeting the unc-22 gene in *C. elegans* using long (>25 nt) siRNA transcripts. The authors describe the introduction of thiophosphate residues into these siRNA transcripts by incorporating thiophosphate nucleotide analogs with T7 and T3 RNA polymerase and observed that RNAs with two phosphorothioate modified bases also had substantial decreases in effectiveness as RNAi. Further, Parrish et al. reported that phosphorothioate modification of more than two residues greatly destabilized the RNAs in vitro such that interference activities could not be assayed. Id. at 1081. The authors also tested certain modifications at the 2'-position of the nucleotide sugar in the long siRNA transcripts and found that substituting deoxynucleotides for ribonucleotides produced a substantial decrease in interference activity, especially in the case of Uridine to Thymidine and/or Cytidine to deoxy-Cytidine substitutions. Id. In addition, the authors tested certain base modifications, including substituting, in sense and anti-sense strands of the siRNA, 4-thiouracil, 5-bromouracil, 5-iodouracil, and 3-(aminoallyl) uracil for uracil, and inosine for guanosine. Whereas 4-thiouracil and 5-bromouracil substitution appeared to be tolerated, Parrish reported that inosine produced a substantial decrease in interference activity when incorporated in either strand. Parrish also reported that incorporation of 5-iodouracil and 3-(aminoallyl) uracil in the anti-sense strand resulted in a substantial decrease in RNAi activity as well.

Those skilled in the art will appreciate that it is possible to synthesize and modify the siRNA as desired, using any conventional method known in the art (see Henschel et al. 2004 DEQOR: a web-based tool for the design and quality control of siRNAs. Nucleic Acids Research 32 (Web Server Issue): W113-W120). Further, it will be apparent to those skilled in the art that there are a variety of regulatory sequences (for example, constitutive or inducible promoters, tissue-specific promoters or functional fragments thereof, etc.) which are useful for the anti-sense oligonucleotide, siRNA, or shRNA expression construct/vector.

There are several examples in the art describing sugar, base, phosphate and backbone modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-flouro, 2'-O-methyl, 2'-O-allyl, 2'-H, nucleotide base modifications (for a review see Usman and Cedergren 1992 TIBS. 17: 34; Usman et al. 1994 Nucleic Acids Symp. Ser. 31: 163; Burgin et al. 1996 Biochemistry 35: 14090). Sugar modification of nucleic acid molecules are extensively described in the art.

Additional modifications and conjugations of RNAi agents have been described. Soutschek et al. 2004 Nature 432: 173-178 presented conjugation of cholesterol to the 3'-end of the sense strand of a RNAi agent by means of a pyrrolidine linker, thereby generating a covalent and irreversible conjugate. Chemical modifications (including conjugation with other molecules) of siRNA may also be made to improve the in vivo pharmacokinetic retention time and efficiency.

In various embodiments of the present disclosure, the RNAi agent to Beta-Catenin comprises at least one 5'-uridine-adenine-3' (5'-ua-3') dinucleotide, wherein the uridine is a 2'-modified nucleotide; at least one 5'-uridine-guanine-3' (5'-ug-3') dinucleotide, wherein the 5'-uridine is a 2'-modified nucleotide; at least one 5'-cytidine-adenine-3' (5'-ca-3') dinucleotide, wherein the 5'-cytidine is a 2'-modified nucleotide; and/or at least one 5'-uridine-uridine-3' (5'-uu-3') dinucleotide, wherein the 5'-uridine is a 2'-modified nucleotide.

In various embodiments of the present disclosure, the RNAi agent comprises a 2'-modification selected from the group consisting of: 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), and 2'-O—N-methylacetamido (2'-O-NMA).

In another embodiment, the RNAi comprises a gap or missing base. For example, the phosphate-sugar backbone may be present, but the base missing.

In another embodiment, the RNAi agent has a single-stranded nick (e.g., a break or missing bond in the backbone). In various embodiments, a single-stranded nick can be in either the sense or anti-sense strand, or both.

This nick can be, for example, in the sense strand, producing a small internally segmented interfering RNA, or sisiRNA, which may have less off-target effects than the corresponding RNAi agent without a nick.

The anti-sense nucleic acid or RNAi agent can also have an alternative backbone such as locked nucleic acid (LNA), Morpholino, peptidic nucleic acid (PNA), threose nucleic acid (TNA), or glycol nucleic acid (GNA), FANA, boranophosphate RNA, or be primarily RNA with a few nucleotides which are substituted by DNA, LNA, PNA, TNA, GNA, FANA, boranophosphate, or the like, and/or it can be labeled (e.g., radiolabeled or otherwise tagged).

One or both strands can comprise an alternative backbone

In yet another embodiment, the RNAi agent employed by the methods of the present disclosure can include an α-anomeric nucleic acid molecule. An α-anomeric nucleic acid molecule forms specific double-stranded hybrids with complementary RNA in which, contrary to the usual (3-units, the strands run parallel to each other. Gaultier et al. 1987 Nucleic Acids. Res. 15: 6625-6641. The RNAi agent can also comprise a 2'-o-methylribonucleotide (Inoue et al. 1987 Nucleic Acids Res. 15: 6131-6148) or a chimeric RNA-DNA analogue (Inoue et al. 1987 FEBS Lett. 215: 327-330).

Alternatively, gene expression can be inhibited by targeting nucleotide sequences complementary to the regulatory region of Beta-Catenin (e.g., the promoter and/or enhancers) to form triple helical structures that prevent transcription of the Beta-Catenin gene. See generally, Helene 1991 Anticancer Drug Des. 6(6): 569-84; Helene et al. 1992 Ann N.Y. Acad. Sci. 660: 27-36; and Maher 1992, Bioassays 14(12): 807-15.

Production of RNAi Agents

The RNAi agent can be produced biologically within a cell using an expression vector into which a nucleic acid has been subcloned in an anti-sense orientation (i.e., RNA transcribed from the inserted nucleic acid will be in an anti-sense orientation to a target nucleic acid of interest). The RNAi agent can also be produced biologically using an expression vector into which a nucleic acid has been subcloned as an shRNA construct (eg., RNA transcribed from the inserted nucleic acid will have a first region in an anti-sense orientation to a target nucleic acid of interest, a second region that comprises a loop or hinge, and a third region in a sense orientation to the target nucleic acid of interest, wherein the first and third regions of the transcript preferably hydribize to each other, thereby forming a stem-and-loop structure.

Methods of producing RNAi agents are well-known in the art and available to persons of ordinary skill in the art.

Kits for synthesis of RNAi are commercially available from, e.g., New England Biolabs and Ambion.

Delivery of RNAi Agents

RNAi agents of the present disclosure can be delivered or introduced (e.g., to a cell in vitro, to a test animal, or to a human) by any means known in the art.

The RNAi agents of the present disclosure are typically administered to a subject or generated in situ such that they hybridize with cellular mRNA and/or genomic DNA encoding Beta-Catenin, and inhibit expression by inhibiting transcription and/or translation. An example of a route of administration of RNAi agents includes direct injection at a tissue site. Alternatively, RNAi agents can be modified to target selected cells and then administered systemically. For example, for systemic administration, anti-sense molecules can be modified such that they specifically bind to receptors or antigens expressed on a selected cell surface, e.g., by linking the anti-sense nucleic acid molecules to peptides or antibodies which bind to cell surface receptors or antigens. The anti-sense nucleic acid molecules can also be delivered to cells using vectors well known in the art and described in, for example, US20070111230. To achieve sufficient intracellular concentrations of the anti-sense molecules, vector constructs in which the anti-sense nucleic acid molecule is placed under the control of a strong pol II or pol III promoter are preferred.

"Introducing into a cell," when referring to a RNAi agent, means facilitating or effecting uptake or absorption into the cell, as is understood by those skilled in the art. Absorption or uptake of a RNAi agent can occur through unaided diffusive or active cellular processes, or by auxiliary agents or devices. The meaning of this term is not limited to cells in vitro; a RNAi agent may also be "introduced into a cell," wherein the cell is part of a living organism. In such an instance, introduction into the cell will include the delivery to the organism. For example, for in vivo delivery, a RNAi agent can be injected into a tissue site or administered systemically. In vivo delivery can also be by a beta-glucan delivery system, such as those described in U.S. Pat. Nos. 5,032,401 and 5,607,677, and U.S. Publication No. 2005/0281781. In vitro introduction into a cell includes methods known in the art such as electroporation and lipofection. Further approaches are described herein below or known in the art.

Delivery of RNAi agent to tissue is a problem both because the material must reach the target organ and must also enter the cytoplasm of target cells. RNA cannot penetrate cellular membranes, so systemic delivery of naked RNAi agent is unlikely to be successful. RNA is quickly degraded by RNAse activity in serum. For these reasons, other mechanisms to deliver RNAi agent to target cells has been devised. Methods known in the art include but are not limited to: viral delivery (retrovirus, adenovirus, lentivirus, baculovirus, AAV); liposomes (Lipofectamine, cationic DOTAP, neutral DOPC) or nanoparticles (cationic polymer, PEI), bacterial delivery (tkRNAi), electroporation, and also chemical modification (LNA) of siRNA to improve stability. Xia et al. 2002 Nat. Biotechnol. 20 and Devroe et al. 2002. BMC Biotechnol. 2 1: 15, disclose incorporation of siRNA into a viral vector. Porphysomes can also be used to deliver RNAi agents. Lovell et al. 2001 Nature Mater. 10: 324-32; and WO 2011/044671. Other systems for delivery of RNAi agents are contemplated and the RNAi agents of the present disclosure can be delivered by various methods yet to be found and/or approved by the FDA or other regulatory authorities. RNAi agents of the present disclosure can delivered in a suitable pharmaceutical composition. Several of these are described in greater detail, below.

Pharmaceutical Compositions of RNAi Agents

As used here, a "pharmaceutical composition" comprises a pharmaceutically effective amount of one or more Beta-Catenin RNAi agent, a pharmaceutically acceptable carrier, and, optionally, an additional disease treatment which works synergistically with the RNAi agent. The additional disease treatment can be additional RNAi agent(s) to Beta-Catenin, and/or additional RNAi agent(s) to another gene. As used herein, "pharmacologically effective amount," "therapeutically effective amount" or simply "effective amount" refers to that amount of a RNAi agent effective to produce the intended pharmacological, therapeutic or preventive result. For example, if a given clinical treatment is considered effective when there is at least a 10% reduction in a measurable parameter associated with a disease or disorder, a therapeutically effective amount of a drug for the treatment of that disease or disorder is the amount necessary to effect at least a 10% reduction in that parameter. In this embodiment, a therapeutically effective amount of a RNAi agent targeting Beta-Catenin can reduce Beta-Catenin protein levels by at least 10%. In additional embodiments, a given clinical treatment is considered effective where there is at least a 15, 20, 25, 30, 35, 40, 45, 50, 55, 60, 65, 70, 75, 80, 85, 90, or 95% reduction in a measurable parameter associated with a disease or disorder, and the therapeutically effective amount of a drug for the treatment of that disease or disorder is the amount necessary to effect at least a 15, 20, 25, 30, 35, 40, 45, 50, 55, 60, 65, 70, 75, 80, 85, 90, or 95% reduction, respectively, in that parameter.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. Agents included in drug formulations are described further herein.

The pharmaceutical compositions comprising a Beta-Catenin RNAi agent can be in solid form, for example, powders, granules, tablets, pills, gelcaps, gelatin capsules, liposomes, suppositories, chewable forms, or patches. The pharmaceutical compositions comprising a Beta-Catenin RNAi agent can also be presented in liquid form, for example, solutions, emulsions, suspensions, elixirs, or syrups. Appropriate liquid supports can be, for example, water, organic solvents such as polyol, such as glycerol or glycols, including propylene glycol and polyethylene glycol, or ethanol, Cremophor EL, or mixtures thereof, in varying proportions, in water. The compositions can comprise nano-sized amorphous or crystalline granules coated with albumin or a surfactant.

Appropriate supports can include, for example, antibacterial and antifungal agents, buffering agents, calcium phosphate, cellulose, methyl cellulose, chlorobutanol, cocoa butter, colorings, dextrin, emulsifiers, enteric coatings, flavorings, gelatin, isotonic agents, lecithin, magnesium stearate, perfuming agents, polyalcohols such as mannitol, injectable organic esters such as ethyl oleate, paraben, phenol sorbic acid, polyethylene glycol, polyvinylpyrrolidine, phosphate buffered saline (PBS), preserving agents, propylene glycol, sodium carboxymethylcellulose, sodium chloride, sorbitol, various sugars (including, but not limited to, sucrose, fructose, galactose, lactose and trehalose), starch, suppository wax, talc, vegetable oils, such as olive oil and corn oil, vitamins, wax, and/or wetting agents. For Beta-Catenin RNAi agents, a preferred support comprises dextran and water, e.g. 5% dextrose in water (D5W).

The biologically inert portion of the pharmaceutical composition can optionally be erodible, allowing timed release of the RNAi agent.

The pharmaceutical composition can comprise additional components which aid in delivery, stability, efficacy, or reduction of immunogenicity.

Additional Components of a Pharmaceutical Composition Comprising a RNAi Agent to Beta-Catenin Additional components of a pharmaceutical composition comprising a RNAi Agent to Beta-Catenin can be added to aid in delivery, stability, efficacy, or reduction of immunogenicity.

Liposomes have been used previously for drug delivery (e.g., delivery of a chemotherapeutic). Liposomes (e.g., cationic liposomes) are described in PCT publications WO02/100435A1, WO03/015757A1, and WO04029213A2; U.S. Pat. Nos. 5,962,016; 5,030,453; and 6,680,068; and U.S. Patent Application 2004/0208921. A process of making liposomes is also described in WO04/002453A1. Furthermore, neutral lipids have been incorporated into cationic liposomes (e.g., Farhood et al. 1995).

Cationic liposomes have been used to deliver RNAi agent to various cell types (Sioud and Sorensen 2003; U.S. Patent Application 2004/0204377; Duxbury et al., 2004; Donze and Picard, 2002).

Use of neutral liposomes disclosed in Miller et al. 1998, and U.S. Patent Application 2003/0012812.

As used herein, the term "SNALP" refers to a stable nucleic acid-lipid particle. A SNALP represents a vesicle of lipids coating a reduced aqueous interior comprising a nucleic acid such as an iRNA or a plasmid from which an iRNA is transcribed. SNALPs are described, e.g., in U.S. Patent Application Publication Nos. 20060240093, 20070135372, and in International Application No. WO 2009082817.

Chemical transfection using lipid-based, amine-based and polymer-based techniques, is disclosed in products from Ambion Inc., Austin, Tex.; and Novagen, EMD Biosciences, Inc, an Affiliate of Merck KGaA, Darmstadt, Germany); Ovcharenko D (2003) "Efficient delivery of siRNAs to human primary cells." Ambion TechNotes 10 (5): 15-16). Additionally, Song et al. (Nat Med. published online (Fete 1 0, 2003) doi: 10.1038/nm828) and others [Caplen et al. 2001 Proc. Natl. Acad. Sci. (USA), 98: 9742-9747; and McCaffrey et al. Nature 414: 34-39] disclose that liver cells can be efficiently transfected by injection of the siRNA into a mammal's circulatory system.

A variety of molecules have been used for cell-specific RNAi agent delivery. For example, the nucleic acid-condensing property of protamine has been combined with specific antibodies to deliver siRNAs. Song et al. 2005 Nat Biotech. 23: 709-717. The self-assembly PEGylated polycation polyethylenimine (PEI) has also been used to condense and protect siRNAs. Schiffelers et al. 2004 Nucl. Acids Res. 32: e149, 141-1 10.

The siRNA-containing nanoparticles were then successfully delivered to integrin-overexpressing tumor neovasculature. Hu-Lieskovan et al. 2005 Cancer Res. 65: 8984-8992.

The RNAi agents of the present disclosure can be delivered via, for example, Lipid nanoparticles (LNP); neutral liposomes (NL); polymer nanoparticles; double-stranded RNA binding motifs (dsRBMs); or via modification of the RNAi agent (e.g., covalent attachment to the dsRNA).

Lipid nanoparticles (LNP) are self-assembling cationic lipid based systems. These can comprise, for example, a neutral lipid (the liposome base); a cationic lipid (for siRNA loading); cholesterol (for stabilizing the liposomes); and PEG-lipid (for stabilizing the formulation, charge shielding and extended circulation in the bloodstream).

The cationic lipid can comprise, for example, a headgroup, a linker, a tail and a cholesterol tail. The LNP can have, for example, good tumor delivery, extended circulation in the blood, small particles (e.g., less than 100 nm), and stability in the tumor microenvironment (which has low pH and is hypoxic).

Neutral liposomes (NL) are non-cationic lipid based particles.

Polymer nanoparticles are self-assembling polymer-based particles.

Double-stranded RNA binding motifs (dsRBMs) are self-assembling RNA binding proteins, which will need modifications.

In various embodiments of the present disclosure, the RNAi agent to Beta-Catenin is ligated to one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized litho-cholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and transferrin.

The RNAi agents of the present disclosure can be prepared in a pharmaceutical composition comprising various components appropriate for the particular method of administration of the RNAi agent.

Administration of a Pharmaceutical Composition Comprising a RNAi Agent

The pharmaceutical composition comprising a Beta-Catenin can be administered by buccal, inhalation (including insufflation and deep inhalation), nasal, oral, parenteral, implant, injection or infusion via epidural, intra-arterial, intra-articular, intra-capsular, intra-cardiac, intra-cerebroventricular, intracranial, intradermal, intramuscular, intra-orbital, ocular, intraperitoneal, intra-spinal, intrasternal, intrathecal, intravenous, subarachnoid, sub-capsular, subcutaneous, sub-cuticular, transendothelial, transtracheal, transvascular, rectal, sublingual, topical, and/or vaginal routes. This may be by injection, infusion, dermal patch, or any other method known in the art. The formulation can be powdered, nebulized, aerosolized, granulized or otherwise appropriately prepared for delivery. The administration, if liquid, may be slow or via bolus, though, under some circumstances known in the art, bolus injections may lead to loss of material through the kidneys.

The pharmaceutical compositions comprising a Beta-Catenin RNAi agent can be administered with medical devices known in the art. For example, in a particular embodiment, a RNAi agent can be administered with a needle-less hypodermic injection device, such as the devices disclosed in U.S. Pat. Nos. 5,399,163, 5,383,851, 5,312,335, 5,064,413, 4,941,880, 4,790,824, or 4,596,556. Examples of well-known implants and modules useful in the present disclosure include: U.S. Pat. No. 4,487,603, which discloses an implantable micro-infusion pump for dispensing medication at a controlled rate; U.S. Pat. No. 4,486,194, which discloses a therapeutic device for administering medications through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multi-chamber compartments; and U.S. Pat. No. 4,475,196, which discloses an osmotic drug delivery system. Many other such implants, delivery systems, and modules are known to those skilled in the art.

In certain embodiments, the pharmaceutical compositions comprising a RNAi agent can be formulated to ensure proper distribution in vivo. Administration of a RNAi agent to Beta-Catenin can be systemic (whole-body) or, particularly, targeted to tissues or organs that express (or over-express or demonstrate a hyper-activity of) Beta-Catenin. Methods for targeting these particular tissues or organs are described herein, and/or are known in the art. For example, they can be formulated in liposomes. For methods of manufacturing liposomes, see, e.g., U.S. Pat. Nos. 4,522,811; 5,374,548; and 5,399,331. The liposomes may comprise one or more moieties which are selectively transported into specific cells or organs, thus enhance targeted drug delivery (see, e.g., V. V. Ranade (1989) J. Clin. Pharmacol. 29: 685).

Example targeting moieties include folate or biotin (see, e.g., U.S. Pat. No. 5,416,016 to Low et al.); mannosides (Umezawa et al., (1988) Biochem. Biophys. Res. Commun. 153: 1038); antibodies (P. G. Bloeman et al. (1995) FEBS Lett. 357: 140; M. Owais et al. (1995) Antimicrob. Agents Chemother. 39: 180); surfactant protein A receptor (Briscoe et al. (1995) Am. J. Physiol. 1233: 134), different species of which may comprise the formulations of the present disclosures, as well as components of the invented molecules; p120 (Schreier et al. (1994) J. Biol. Chem. 269: 9090); see also K. Keinanen; M. L. Laukkanen (1994) FEBS Lett. 346: 123; J. J. Killion; I. J. Fidler (1994) Immunomethods 4: 273.

The present disclosure thus encompasses pharmaceutical compositions comprising one or more RNAi agents to Beta-Catenin, which can optionally comprise various modifications and/or additional components, for use in treatment of Beta-Catenin-related diseases.

Measuring the Effect of a RNAi Agent on Beta-Catenin Activity, Level, Expression or Compartmentalization Any method known in the art can be used to measure changes in Beta-Catenin activity, level, cellular distribution, and/or expression induced or altered by Beta-Catenin RNAi agent. Measurements can be performed at multiple timepoints, prior to, during and after administration of the RNAi agent, to determine the effect of the RNAi agent.

The terms "silence," "inhibit the expression of," "downregulate the expression of," "suppress the expression of," and the like, in so far as they refer to a Beta-Catenin gene, herein refer to the at least partial suppression of the expression of a Beta-Catenin gene, as manifested by a reduction of the amount of Beta-Catenin mRNA which may be isolated from or detected in a first cell or group of cells in which a Beta-Catenin gene is transcribed and which has or have been treated such that the expression of a Beta-Catenin gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\% \qquad \text{Equation 1}$$

Alternatively, the degree of inhibition may be given in terms of a reduction of a parameter that is functionally linked to Beta-Catenin gene expression, e.g., the amount of protein encoded by a Beta-Catenin gene, etc. In principle, Beta-Catenin gene silencing may be determined in any cell expressing Beta-Catenin, either constitutively or by genomic engineering, and by any appropriate assay. However, when a reference or control is needed in order to determine whether a given RNAi agent inhibits the expression of the Beta-Catenin gene by a certain degree and therefore is encompassed by the instant disclosure, the assays provided in the Examples below shall serve as such reference.

For example, in certain instances, expression of a Beta-Catenin gene is suppressed by at least about 10%, 15%, 20%, 25%, 30%, 35%, 40%, 45%, or 50% by administration of a RNAi agent featured in the present disclosure. In some embodiments, a Beta-Catenin gene is suppressed by at least about 60%, 70%, or 80% by administration of a RNAi agent featured in the present disclosure. In some embodiments, a Beta-Catenin gene is suppressed by at least about 85%, 90%, or 95% or more by administration of a RNAi agent, as described herein.

The ability of a RNAi agent to suppress Beta-Catenin can be first tested in vitro (e.g., using test cells such as HeLa cells).

RNAi agents which can suppress Beta-Catenin in vitro can then be tested for immunostimulation using, for example, a PBMC (peripheral blood mononuclear cell) assay. RNAi agents can also be tested in animal tests. Test and control animals include those which over-express or under-express Beta-Catenin, as described in, for example, Chenn et al. 2003 Cer. Cortex 13: 599-606. RNAi agents which suppress or alter the level, activity and/or expression of Beta-Catenin can be used in medicaments to treat various Beta-Catenin-related diseases.

By "lower" in the context of Beta-Catenin or a symptom of a Beta-Catenin-related disease is meant a statistically significant decrease in such level. The decrease can be, for example, at least 10%, at least 20%, at least 30%, at least 40%, at least 50%, at least 60%, at least 70%, at least 80%, at least 90%, at least 95%, or more. If, for a particular disease, or for an individual suffering from a particular disease, the levels or expression of Beta-Catenin are elevated, treatment with a Beta-Catenin RNAi agent of the present disclosure can particularly reduce the level or expression of Beta-Catenin to a level considered in the literature as within the range of normal for an individual without such disorder.

The level or expression of Beta-Catenin can be measured by evaluation of mRNA (e.g., via Northern blots or PCR), or protein (e.g., Western blots). The effect of a RNAi agent on Beta-Catenin expression can be determined by measuring Beta-Catenin gene transcription rates (e.g., via Northern blots; or reverse transcriptase polymerase chain reaction or real-time polymerase chain reaction). Direct measurements can be made of levels of Beta-Catenin (which is expressed by the cell surface), e.g. by Western blots of tissues in which Beta-Catenin is expressed. The presence of Beta-Catenin in various cellular compartments (membrane, cytoplasm, and nucleus) can also be determined.

As used herein, "down-regulates" refers to any statistically significant decrease in a biological activity and/or expression of Beta-Catenin, including full blocking of the activity (i.e., complete inhibition) and/or expression. For example, "down-regulation" can refer to a decrease of at least about 10, 20, 30, 40, 50, 60, 70, 80, 90 or 100% in Beta-Catenin level, activity and/or expression.

As used herein, the term "inhibit" or "inhibiting" Beta-Catenin refers to any statistically significant decrease in biological level, activity and/or expression of Beta-Catenin, including full blocking of the activity and/or expression. For example, "inhibition" can refer to a decrease of at least about 10, 20, 30, 40, 50, 60, 70, 80, 90 or 100% in Beta-Catenin level, activity and/or expression. As used herein, the term "inhibit" similarly refers to a significant decrease in level, activity and/or expression, while referring to any other biological agent or composition.

By "level", it is meant that the Beta-Catenin RNAi agent can alter the level of Beta-Catenin, e.g., the level of Beta-Catenin mRNA or the level of Beta-Catenin protein, or the level of activity of Beta-Catenin.

Some diseases, such as adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing, and similar and related diseases, are characterized by excessive and/or mutated Beta-Catenin activity, and/or unusual Beta-Catenin distribution within the cell. Thus, in various embodiments, administration of a RNAi agent to Beta-Catenin particularly establishes or re-establishes a normal or approximately normal level of Beta-Catenin activity, expression, distribution, and/or level.

By "normal" or "approximately normal" in terms of level, expression and/or activity, is meant at least: about 50%, about 60%, about 70%, about 80%, about 90%, and/or about 100%; and/or no more than: about 100%, about 120%, about 130%, about 140%, or about 150% of the level, expression or activity of Beta-Catenin in a healthy cellular compartment, cell, tissue, or organ. In one embodiment, administration of the appropriate amount of the appropriate Beta-Catenin RNAi agent restores Beta-Catenin level, activity and/or expression levels to about 50% to about 150%, more particularly about 60% to about 140%, more particularly to about 70% to about 130%, more particularly to about 80% to about 120%, more particularly to about 90% to about 110%, and most particularly to about 100% of that of a healthy cell, tissue or organ. Administration of a Beta-Catenin RNAi to a patient with a Beta-Catenin-related disease thus particularly restores the level, activity, and/or expression of Beta-Catenin to an approximately normal level, as determined by direct measurements of Beta-Catenin mRNA or protein levels, or indirect determinations, such as analyses of histological samples or levels of tissue samples. The RNAi agents of the present disclosure can also achieve a normal or approximately normal level of distribution of Beta-Catenin within the cell (e.g., in the membrane but not in the cytoplasm or nucleus).

In some Beta-Catenin-related cancers, Beta-Catenin is required for tumor growth but is not amplified, over-expressed or mis-localized. A reduction in Beta-Catenin expression, level or activity should thus limit tumor growth. The disclosure thus encompasses methods wherein Beta-Catenin expression, level or activity is reduced to an expression, level or activity which is lower than normal.

In addition, in various embodiments, depending on the disease condition and biological context, it is acceptable to use the RNAi agents of the present disclosure to establish a level of Beta-Catenin expression, activity and/or level which is below the normal level, or above the normal level.

Beta-Catenin-Related Diseases

The present disclosure encompasses RNAi agents to Beta-Catenin and administration of the RNAi agents to humans and non-human animals to treat various Beta-Catenin-related diseases.

By "Beta-Catenin-related disease" is meant any disease related to a mutation and/or dysfunction in the level, expression, cellular location, and/or activity of Beta-Catenin, and/or any disease which can be treated, prevented and/or ameliorated by modulating the level, expression, cellular location, and/or activity of Beta-Catenin. In some cases, the "Beta-Catenin-related disease" includes cancers wherein Beta-Catenin is required for tumor growth but is not amplified, over-expressed or mis-localized. A reduction in Beta-Catenin expression, level or activity should thus limit tumor growth. In various embodiments of the present disclosure, a Beta-Catenin-related disease can be treated and/or ameliorated by a RNAi agent to Beta-Catenin.

Beta-Catenin-related diseases are often associated with aberrations in the canonical Wnt/Beta-Catenin pathway. Wnt signaling is involved in virtually every aspect of embryonic development and also controls homeostatic self-renewal in a number of adult tissues. Germline mutations in the Wnt pathway cause several hereditary diseases, and somatic mutations are associated with cancer of the intestine and a variety of other tissues. In the Wnt pathway, when Wnt receptor complexes are not bound by ligand, the serine/threonine kinases, CK1 and GSK3α/β, phosphorylate Beta-Catenin. Phosphorylated Beta-Catenin is recognized by the F box/WD repeat protein β-TrCP, a component of a dedicated E3 ubiquitin ligase complex. Following ubiquitination, Beta-Catenin is targeted for rapid destruction by the proteosome. In the nucleus, the binding of Groucho to TCF (T cell factor) inhibits the transcription of Wnt target genes, including proto-oncogene c-myc. However, Beta-Catenin accumulation in the nucleus can lead to activation of these Wnt target genes. For example, once bound by Wnt, the Frizzled (Fz)/LRP co-receptor complex activates the canonical signaling pathway. Fz interacts with Dsh, a cytoplasmic protein that functions upstream of Beta-Catenin and the kinase GSK3β. Wnt signaling controls phosphorylation of LRP by GSK3β and casein kinase I-γ (CK1γ), thus regulating the docking of Axin. The recruitment of Axin away from the destruction complex leads to the stabilization of beta-catenin in the cytoplasm. Once in the nucleus, Beta-Catenin displaces Groucho from TCF/LEF to promote the transcription of Wnt target genes, including c-myc. Moon et al. 2002 science 296: 1644-1646; Nelson et al. 2004 Science 303: 1483-1487; and Clevers 2006 Cell 127: 469-480; and references cited therein.

Beta-Catenin-related diseases are thus often associated with a mutated form of the protein, and/or an elevated level of mutant or wild-type Beta-Catenin, and/or presence of Beta-Catenin in cytoplasm and/or nucleus. In normal gastric mucosa, Beta-Catenin is localized to the cell membrane. Clements et al. 2002 Cancer Res. 62: 3503-6. As noted above, in the absence of growth or differentiation signals, cytoplasmic Beta-Catenin is rapidly turned over, under the control of the APC (adenomatous polyposis coli) protein and GSK-3β. Beta-Catenin accumulates in the cytoplasm in some cancer cells, chronic wounds and other diseased cells and tissues. Nuclear translocation can also occur. Beta-Catenin accumulation can result in interaction with the T-cell factor 4 or lymphoid-enhancer factor family of transcriptional activators, and can result in the activation of some developmentally-related genes and/or proto-oncogenes, including c-myc. Behrens et al. 1996 Nature 382: 638-642; and He et al. 1998 Science 281: 1509-1512.

As noted above, Beta-Catenin turnover occurs in the proteosome, where Beta-Catenin is degraded after targeted phosphorylation of highly-conserved Ser and Thr residues (Ser33, Ser37, Thr41, and Ser45) and ubiquitination in the $NH_2$ terminus. Mutations in these Ser and Thr residues result in accumulated Beta-Catenin and are associated with various cancers. A Ser37 to Phe37 mutation, at a mutational hotspot, is associated with Beta-Catenin accumulation and increased half-life in the SK23 mel (melanoma) cell line. Rubinfeld et al. 1997 Science 275: 1790-1792. A Ser45 to Tyr45 mutation in the 624 mel cell line also increased the half-life of Beta-Catenin. Rubinfeld et al. 1997. Other deletions and mutations of these residues resulting in Beta-Catenin accumulation are described in Funayama et al. 1995 J. Cell Biol. 128: 959; Munemitsu et al. 1996 Mol. Cell. Biol. 16: 4088; Yost et al. 1996 Genes Dev. 10: 1443; and Ha et al. 2002 Acta Derm. Venereol. 82: 428-431. Altered phosphorylation of Beta-Catenin is also associated with breast cancer. Sommers et al. 1994 Cancer Res. 54: 3544-3552.

Beta-Catenin mutations outside the four Ser and Thr residues have also been associated with disease states. A nearby mutation of Aspartic acid 32 to Tyr was detected in a prostate cancer cell line. Voeller et al. 1998 Cancer Res. 58: 2520-2523. The 321-bp deletion from +82 to +402 was found in the HSC-39 gastric cancer cell line, Kawanishi et al. 1995 Mol. Cell. Biol. 15: 1175-1181. Other mutations at positions 32, 33, 34, 37 and 41 have been associated with pilomatrixomas (skin tumors of unknown origin and aetiology). Chan et al. 1999 Nature Genet. 21: 410-413. Additional mutations associated with gastric cancer were found at positions 8, 11, 13, 21, 24, 25, 28, 29, 32, 37, 39, 47, 48 and 55. Clements et al. 2002 Cancer Res. 62: 3503-3506. Various mutations in colorectal tumors are described in Miyaki et al. 1999 Cancer Res. 59: 4506-4509. All in all, mutations of Beta-Catenin at positions 8, 11, 13, 21, 24, 25, 28, 29, 32, 33, 34, 37, 39, 41, 45, 47, 48 and 55 have been associated with various cancers and other disease states.

In addition, a 321-bp deletion from +82 to +402 occurs in HSC-39 gastric cancer cell line, Kawanishi et al. 1995 Mol. Cell. Biol. 15: 1175-1181. Additional Beta-Catenin mutations (inside and outside the region of the four Ser and Thr residues) have been associated with medulloblastoma, endometroid ovarian carcinoma, uterine endometrial carcinoma, hepatocellular carcinoma, and prostatic adenocarcinoma. Zurawel et al. 1998 Cancer Res. 58: 896-899; Palacios et al. 1998 Cancer Res. 58: 1344-1347; Fukuchi et al. 1998 Cancer Res. 58: 3526-3528; Miyoshi et al. 1998 Cancer Res. 58: 2524-2527; Voeller et al. 1998 Cancer Res. 2520-2523; and Iwao et al. 1998 Cancer Res. 58: 1021-1026; and Garcia-Rostan et al. 1999 Cancer Res. 59: 1811-1815.

Alterations in the genetic or biochemical context can also alter Beta-Catenin level or activity. Excess intracellular Beta-Catenin is expressed in colon and other cancer cells with a defective APC. Munemitsu et al. 1995 Proc. Natl. Acad. Sci. USA 92:3046. A reduced cell-cell adhesion is caused by tyrosine-phosphorylation of Beta-Catenin with v-src gene transfection. Behrens et al. 1993 J. Cell Biol. 120: 757-766; Hamaguchi et al. 1993 EMBO J. 12:307-314; Matsuyoshi et al. 1992 J. Cell Biol. 118: 703-714.

In addition, the term "Beta-Catenin-related disease" includes those diseases in which Beta-Catenin (in normal form, mutant form, and/or in an elevated level of normal or mutant form and/or altered localization within the cell) directly or indirectly causes an increase in expression, level or activity of a factor involved in a disease state; for example, nuclear beta-catenin activates production of c-myc, which is involved in several diseases. In addition, "Beta-Catenin-related disease" includes those diseases related to aberrations in the Wnt/Beta-Catenin pathway. For example, abnormalities of the Wnt/Beta-Catenin pathway are associated with various cancers, osteoporosis, ageing, oligodontia, and degenerative diseases. Clevers et al. 2006 Cell 127: 469-480; Moon et al. 2004 Nat. Rev. Genet. 5: 691-701; He et al. 2004 Develop. 131: 1663-1677; Logan et al. 2004 Ann. Rev. Cell. Dev. Biol. 20: 781-810. In addition, Wilms tumors (a pediatric kidney cancer) are sometimes associated with mutations in the WTX gene, a tumor suppressor gene which has recently been discovered to be involved in the Wnt/Beta-Catenin pathway. Huang et al. 2008. Curr. Opin. Cell Biol. 20: 119-125.

In particular, the term "Beta-Catenin-related disease" includes adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing. See: Delektorskaya et al. 2008. Bull. Exp. Biol. Med. 146: 616-619; Li et al. 2005 World J. Gastroent. 11: 2117-23; Liu et al. 2010 J. Dental Res. 89: 318-330; Noda et al. 1009 Br. J. Cancer 100: 1647-1658; Saegusa et al. 2009 Am. J. Pathol. 174: 2107-2115; Saldanha et al. Br. J. Dermatol. 151: 157-64; Stojadinovic et al. Am. J. Pathol. 167: 59-69; Thompson et al. 2007 Hepatology 45: 1298-305; Wang et al. 2008 Cancer Epidemiol. Biomarkers Prev. 17: 2101-8.

RNAi agents to Beta-Catenin can be used to treat Beta-Catenin-related diseases, particularly those diseases associated with altered expression, activity, compartmentalization, and/or levels of Beta-Catenin, or wherein Beta-Catenin is required for disease progression (e.g., tumor growth).

RNAi Agents to Beta-Catenin for Treatment of Beta-Catenin-Related Diseases

The RNAi agents to Beta-Catenin described herein can be formulated into pharmaceutical compositions which can be administered to humans or non-human animals. These compositions can comprise one or more RNAi agents, and, optionally, additional treatments useful for treating Beta-Catenin-related diseases. They can be administered as part of an early/preventative treatment, and can be administered in a therapeutically-effective dosage. The pharmaceutical composition can comprise a pharmaceutical carrier and can be administered by any method known in the art. These various aspects of the present disclosure are described in additional detail below.

RNAi agents to Beta-Catenin can be administered to humans and non-human animals for treatment of Beta-Catenin-related diseases.

In one embodiment of the present disclosure, the compositions comprising a Beta-Catenin RNAi agent can be administered to non-human animals. For example, the compositions can be given to chickens, turkeys, livestock animals (such as sheep, pigs, horses, cattle, etc.), companion animals (e.g., cats and dogs) and can have efficacy in treatment of adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing and similar and related diseases. In each case, the RNAi agent to Beta-Catenin would be selected to match the sequence of the Beta-Catenin of the genome of the animal, and to, particularly, contain at least 1 nt mismatch from all other genes in that animal's genome. The RNAi agents of the present disclosure can thus be used in treatment of Beta-Catenin-related diseases in humans and non-human animals.

As used herein in the context of Beta-Catenin expression, the terms "treat," "treatment," and the like, refer to relief from or alleviation of pathological processes mediated by Beta-Catenin expression. In the context of the present disclosure insofar as it relates to any of the other conditions recited herein below (other than pathological processes mediated by Beta-Catenin expression), the terms "treat," "treatment," and the like mean to relieve or alleviate at least one symptom associated with such condition, or to slow or reverse the progression or anticipated progression of such condition.

By "treatment" is also meant prophylaxis, therapy, cure, or any other change in a patient's condition indicating improvement or absence of degradation of physical condition. By "treatment" is meant treatment of Beta-Catenin-related disease (e.g., adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing, and similar and related diseases), or any appropriate treatment of any other ailment the patient has. As used herein, the terms "treatment" and "treat" refer to both prophylactic or preventative treatment and curative or disease-modifying treatment, including treatment of patients at risk of contracting a disease or suspected of having a disease, as well as patients already ill or diagnosed as suffering from a condition. The terms "treatment" and "treat" also refer to the maintenance and/or promotion of health in an individual not suffering from a disease but who may be susceptible to developing an unhealthy condition. In one embodiment, "treatment" does not encompass prevention of a disease state. Thus, the present disclosure is useful for suppressing expression of the Beta-Catenin gene and/or treating a Beta-Catenin-related disease in an individual afflicted by a Beta-Catenin-related disease, or an individual susceptible to a Beta-Catenin-related disease. An individual "afflicted" by a Beta-Catenin-related disease has demonstrated detectable symptoms characteristics of the disease, or had otherwise been shown clinically to have been exposed to or to carry Beta-Catenin-related disease pathogens or markers. As non-limiting examples, an individual afflicted by a Beta-Catenin-related disease can show outward symptoms; or can show no outward symptoms but can be shown with a clinical test to carry protein markers associated with a Beta-Catenin-related disease, or proteins or genetic material associated with a pathogen in the blood.

Treatment of some Beta-Catenin-related diseases may be more efficacious if administered early rather than later. Thus, in one particular embodiment, the RNAi agent to Beta-Catenin is administered early, prior to disease manifestation, and/or as a preventative agent, rather than administered after disease establishment.

Additional Treatments Used in Addition to or in Conjunction with RNAi Agents to Beta-Catenin Treatments of Beta-Catenin-related diseases can thus comprises various treatments, comprising a Beta Beta-Catenin RNAi agent, and optionally further comprising an additional treatment, which can be a method (or procedure), and/or an additional composition (e.g., an agent or additional RNAi agent).

Beta-Catenin-related diseases include adenomatous polyposis of the colon, colorectal cancer, basal cell carcinoma, breast cancer, kidney cancer, Wilms tumors, medulloblastoma, ovarian cancer, adrenocortical tumors, gastric cancer, liver cancer, melanoma, pancreatic cancers, prostate cancer, renal cancer, ectopic teeth and taste papillae, skin cancer, pilomatrixoma, anaplastic thyroid carcinoma, and uterine carcinosarcoma, oligodontia, osteoporosis, ageing, degenerative diseases, bedsores, chronic wounds and impaired wound healing, and similar and related diseases. The use of known treatments for any of these diseases is within the capabilities of one of ordinary skill in the art. Any such additional treatment can be used in conjunction with a RNAi agent to Beta-Catenin.

These additional treatments, which can be administered prior to, simultaneously, or after administration of the RNAi agent(s) to Beta-Catenin, include: 5-fluoro-29-deoxyuridine, 7-hydroxystaurosporine, a goserlin implant, antibiotic, bevacizumab, bicalutamide, bleomycin, camptothecin, carboplatin, cetuximab, cisplatin, colcemid, Cycloheximide, cyclophosphamide, cytarabine, cytosine arabinoside (Ara-C), dacarbazine, docetaxel, doxorubicin, edelfosine, ehlorambucil, epipodophyllotoxin, epirubicin, erlotinib, estramustine, etoposide, fenretinide, finasteride, flavopiridol, fludarabine, fluorouracil, gefitinib, gemeitabine, goserelin, hexamethylmelamine, hydroxyurea, ifosfamide, irinotecan, L-asparaginase, leuprolide, meiphalan, mercaptopurine, methotrexate, mitixantrone, mitomycin, mitoxantrone, nitrogen mustard, octreotide, paclitaxel, pirubicin, Puromycin, sargramostim, staurosporine, steroids, tamoxifen, Taxol, tegafur, teniposide, topotecan, trastuzumab, UFT, 1-Hydroxy-2-imidazol-1-yl-phosphonoethyl) phosphonic acid monohydrate (sold under the tradename Zometa® by Novartis), 2-chloro-N-[4-chloro-3-(2-pyridinyl)phenyl]-4-(methylsulfonyl)-benzamide (also known as GDC-0449, and described in PCT Publication No. WO 06/028958), GDC 0941 (PCT Publication Nos. WO 09/036082 and WO 09/055730), BEZ 235 or NVP-BEZ 235 (PCT Publication No. WO 06/122806), ABT-263 (PCT Publication No. WO 09/155386), 5-azacitidine (sold under the tradename Vidaza®), decitabine (sold under the tradename Dacogen®), 6-thioguanine (sold under the tradename Purinethol®), pemetrexed (sold under the tradename Alimta®), Afutuzumab (available from Roche®), pegfilgrastim (sold under the tradename Neulasta® by Amgen), lenalidomide (also known as CC-5013 sold under the tradename Revlimid®), thalidomide (sold under the tradename Thalomid®), Alemtuzumab (sold under the tradename Campath®), Alitretinoin (sold under the tradename Panretin®), tretinoin (all-trans retinoic acid, also known as ATRA sold under the tradename Vesanoid®), Isotretinoin, bexarotene (sold under the tradename Targretin®), Alvocidib (U.S. Pat. No. 5,621,002), Amifostine (sold under the tradename Ethyol®), leucovorin, aminoglutethimide (sold under the tradename Cytadren®), Anagrelide (sold under the tradename Agrylin®), Anti-nausea drugs, Arsenic trioxide (sold under the tradename Trisenox®), asparaginase (also known as L-asparaginase, Erwinia L-asparaginase sold under the tradenames Elspar® and Kidrolase®), axitinib, bacillus calmette-guerin (sold under the tradenames theraCys® and TICE® BCG), denileukin diftitox (sold under the tradename Ontak®), Bortezomib (sold under the tradename Velcade®), Brivanib Alaninate ((S)—((R)-1-(4-(4-Fluoro-2-methyl-1H-indol-5-yloxy)-5-methylpyrrolo[2,1-f][1,2,4]triazin-6-yloxy)propan-2-yl)2-aminopropanoate, also known as BMS-582664), Cabazitaxel (1-hydroxy-7β,10β-dimethoxy-9-oxo-5β,20-epoxytax-11-ene-2α,4,13α-triyl-4-acetate-13-benzoate-13-[(2R,3S)-3-{[(tert-butoxy)carbonyl]amino}-2-hydroxy-3-phenylpropanoate), larotaxel ((2α,3ξ,4α,5β,7α,10β,13α)-4,10-bis(acetyloxy)-13-({(2R,3S)-3-[(tert-butoxycarbonyl)amino]-2-hydroxy-3-phenylpropanoyl}oxy)-1-hydroxy-9-oxo-5,20-epoxy-7,19-cyclotax-11-en-2-yl benzoate), Capecitabine (sold under the trademark Xeloda® by Roche), Casopitant (sold under the tradenames Rezonic® and Zunrisa® by GlaxoSmithKline), Cervarix® sold by GlaxoSmithKline, Gardasil® sold by Merck, cladribine (also known as 2-chlorodeoxyadenosine (2-CdA) sold under the tradename Leustatin™) Claribine (2-chlorodeoxyadenosine sold under the tradename Leustatin®), Dacetuzumab (also known as SGN-40 or huS2C6, available from Seattle Genetics, Inc), Darbepoetin alfa (sold under the tradename Aranesp® by Amgen), daunorubicin, decitabine (sold under the tradename Dacogen®), Deferasinox (sold under the tradename Exjade® by Novartis), Denosumab (sold under the tradename Prolia® by Amgen), Dulanermin (also known as AMG-951, available from Amgen/Genentech), Elotuzumab (HuLuc63, CAS No. 915296-00-3), Eltrombopag (sold under the tradenames Promacta® and Revolade® by GlaxoSmithKline), etoposide (also known as VP-16 and Etoposide phosphate sold under the tradenames Toposar®, VePesid® and Etopophos®), teniposide (also known as VM-26 sold under the tradename Vumon®), Exemestane (sold under the trademark Aromasin® by Pfizer), letrozole (sold under the tradename Femara® by Novartis), anastrozole (sold under the tradename Arimidex®), Figitumumab (also known as CP-751, 871, available from ACC Corp), robatumumab (CAS No. 934235-44-6), Filgrastim (sold under the tradename Neupogen® by Amgen), floxuridine (sold under the tradename FUDR®), Fluoxymesterone (sold under the tradename Halotestin®), Fulvestrant (sold under the tradename Faslodex®), Gefitnib (sold under the tradename Iressa®), N-[4-[(3-Chloro-4-fluorophenyl)amino]-7-[[(3"S")-tetrahydro-3-furanyl]oxy]-6-quinazolinyl]-4(dimethylamino)-2-butenamide sold under the tradename Tovok® by Boehringer Ingelheim), Gemtuzumab ozogamicin (sold under the tradename Mylotarg® by Pfizer/Wyeth), Hydrocortisone (also known as cortisone, hydrocortisone sodium succinate, hydrocortisone sodium phosphate, and sold under the tradenames Ala-Cort®, Hydrocortisone Phosphate, Solu-Cortef®, Hydrocort Acetate® and Lanacort®), dexamethazone ((8S,9R,10S,11S,13S,14S,16R,17R)-9-fluoro-11,17-dihydroxy-17-(2-hydroxyacetyl)-10,13,16-trimethyl-6,7,8,9,10,11,12,13,14,15,16,17-dodecahydro-3H-cyclopenta[a]phenanthren-3-one), prednisolone (sold under the tradenames Delta-Cortel®, Orapred®, Pediapred® and Prelone®), prednisone (sold under the tradenames Deltasone®, Liquid Red®, Meticorten® and Orasone®), methylprednisolone (also known as 6-Methylprednisolone, Methylprednisolone Acetate, Methylprednisolone Sodium Succinate sold under the tradenames Duralone®, Medralone®, Medrol®, M-Prednisol® and Solu-Medrol®), Ibritumomab tiuxetan (sold under the tradename Zevalin®), idarubicin (sold under the tradenames Idamycin®, Idamycin PFS®), Inotuzumab ozogamicin (also referred to as CMC-544 and WAY-207294, available from Hangzhou Sage Chemical Co., Ltd.), interleukin-2 (also known as aldesleukin and IL-2 sold under the tradename Proleukin®), interleukin-11 (also known as oprevelkin sold under the tradename Neumega®), alpha interferon alfa (also known as IFN-alpha sold under the tradenames Intron® A, and Roferon-A®), Irinotecan (sold under the trademark Camptosar® by Pfizer), topotecan hydrochloride (sold under the tradename Hycamtin® by GlaxoSmithKline), Ixabepilone (sold under the tradename Lxempra® by Bristol-Myers Squibb), lapatinib or lapatinib ditosylate (sold under the trademark Tykerb® by GlaxoSmithKline), Leuprolide or leuprolide acetate (sold under the tradenames Viadure® by Bayer AG, Eligard® by Sanofi-Aventis and Lupron® by Abbott Lab), Linifanib (N-[4-(3-amino-1H-indazol-4-yl)phenyl]-N'-(2-fluoro-5-methylphenyl)urea, also known as ABT 869, available from Genentech), sunitinib malate (sold under the tradename Sutent® by Pfizer), bosutinib (4-[(2,4-dichloro-5-methoxyphenyl)amino]-6-methoxy-7-[3-(4-methylpiperazin-1-yl) propoxy]quinoline-3-carbonitrile, also known as SKI-606, and described in U.S. Pat. No. 6,780,996), dasatinib (sold under the tradename Sprycel® by Bristol-Myers Squibb), armala (also known as pazopanib sold under the tradename Votrient® by GlaxoSmithKline), imatinib and imatinib mesylate (sold under the tradenames Gilvec® and Gleevec® by Novartis), megestrol (also known as megestrol acetate sold under the tradename Megace®), motesanib (N-(2,3-dihydro-3,3-dimethyl-1H-indol-6-yl)-2-[(4-pyridinylmethyl)amino]-3-pyridinecarboxamide, and described in PCT Publication No. WO 02/066470), pasireotide (also known as SOM230, and described in PCT Publication No. WO 02/010192), sorafenib (sold under the tradename Nexavar®), nelarabine ((2R,3S,4R,5R)-2-(2-amino-6-methoxypurin-9-yl)-5-(hydroxymethyl)oxolane-3,4-diol sold under the tradenames Arranon® and Atriance® by GlaxoSmithKline), neratinib (also known as HKI-272, (2E)-N-[4-[[3-chloro-4-[(pyridin-2-yl)methoxy]phenyl]amino]-3-cyano-7-ethoxyquinolin-6-yl]-4-(dimethylamino)but-2-enamide, and described PCT Publication No. WO 05/028443), nilotinib hydrochloride (sold under the tradename Tasigna® by Novartis), Nilutamide (sold under the tradenames Nilandron® and Anandron®), bicalutamide (sold under tradename Casodex®), flutamide (sold under the tradename Fulexin™), N-methyl-2-[[3-[(E)-2-pyridin-2-ylethenyl]-1H-indazol-6-yl]sulfanyl]benzamide, also known as AG013736, and described in PCT Publication No. WO 01/002369, octreotide (also known as octreotide acetate sold under the tradenames Sandostatin® and Sandostatin LAR®). Odanacatib (also know as MK-0822, N-(1-cyanocyclopropyl)-4-fluoro-N²-{(1S)-2,2,2-trifluoro-1-[4'-(methylsulfonyl)biphenyl-4-yl]ethyl}-L-leucinamide, available from Lanzhou Chon Chemicals, ACC Corp., and ChemieTek, and described in PCT Publication no. WO 03/075836), oprelvekin (sold under the tradename Neumega® by Pfizer/Wyeth), oxaliplatin (sold under the tradename Eloxatin® ay Sanofi-Aventis and described in U.S. Pat. No. 4,169,846), Palifermin (sold under the tradename Kepivance® by Amgen), Pamidronate (sold under the tradename Aredia®), zoledronic acid (sold under the tradename Zometa®), panitumumab (sold under the tradename Vectibix® by Amgen), pentostatin (sold under the tradename Nipent®), Pertuzumab (sold under the trademark Omnitarg®, by Genentech), Raloxifene (sold under the tradename Evista®), Rituximab (sold under the trademarks Riuxan® and MabThera® by Genentech/Roche), Romiplostim (sold under the tradename Nplate® by Amgen), tamoxifen (sold under the tradename Novaldex®), Tanespimycin (17-allylamino-17-demethoxygeldanamycin, also known as KOS-953 and 17-AAG, available from SIGMA, and described in U.S. Pat. No. 4,261,989), Temozolomide (sold under the tradenames Temodar® and Temodal® by Schering-Plough/Merck), dactinomycin (also known as actinomycin-D and sold under the tradename Cosmegen®), melphalan (also known as L-PAM, L-sarcolysin, and phenylalanine mustard sold under the tradename Alkeran®), altretamine (also known as hexamethylmelamine (HMM) sold under the tradename Hexalen®), carmustine (sold under the tradename BiCNU®), bendamustine (sold under the tradename Treanda®), busulfan (sold under the tradenames Busulfex® and Myleran®), carboplatin (sold under the tradename Paraplatin®), lomustine (also known as CCNU sold under the tradename CeeNU®), cisplatin (also known as CDDP sold under the tradenames Platinol® and Platinol®-AQ), chlorambucil (sold under the tradename Leukeran®), cyclophosphamide (sold under the tradenames Cytoxan® and Neosar®), dacarbazine (also known as DTIC, DIC and imidazole carboxamide sold under the tradename DTIC-Dome®), altretamine (also known as hexamethylmelamine (HMM) sold under the tradename Hexalen®), ifosfamide (sold under the tradename Ifex®), procarbazine (sold under the tradename Matulane®), mechlorethamine (also known as nitrogen mustard, mustine and mechloroethamine hydrochloride sold under the tradename Mustargen®), streptozocin (sold under the tradename Zanosar®), thiotepa (also known as thiophosphoamide, TESPA and TSPA sold under the tradename Thioplex®, Temsirolimus (sold under the tradename Torisel® by Pfizer), ridaforolimus (formally known as deferolimus, (1R,2R,4S)-4-[(2R)-2 [(1R,9S,12S,15R,16E,18R,19R,21R,23S,24E, 26E,28Z,30S,32S,35R)-1,18-dihydroxy-19,30-dimethoxy-15,17,21,23,29,35-hexamethyl-2,3,10,14,20-pentaoxo-11, 36-dioxa-4-azatricyclo[30.3.1.0$^{4,9}$]hexatriaconta-16,24,26, 28-tetraen-12-yl]propyl]-2-methoxycyclohexyl dimethylphosphinate, also known as AP23573 and MK8669, and described in PCT Publication No. WO 03/064383), everolimus (sold under the tradename Afinitor® by Novartis), Toremifene (sold under the tradename Fareston®), tositumomab (sold under the trademarks Bexxar® by GlaxoSmithKline), ofatumumab (sold under the trademark Arzerra® by GlaxoSmithKline), Tremelimumab (IgG2 monoclonal antibody available from Pfizer, formerly known as ticilimumab, CP-675,206), ipilimumab (CTLA-4 antibody, also known as MDX-010, CAS No. 477202-00-9), vinblastine (also known as vinblastine sulfate, vincaleukoblastine and VLB sold under the tradenames Alkaban-AQ® and Velban®), vincristine (also known as vincristine sulfate, LCR, and VCR sold under the tradenames Oncovin® and Vincasar Pfs®), vinorelbine (sold under the tradename Navelbine®), Voninostat (sold under the tradename Zolinza® by Merck), Xaliproden (also known as SR57746, 1-[2-(2-naphthyl)ethyl]-4-[3-(trifluoromethyl) phenyl]-1,2,3,6-tetrahydropyridine, and described in U.S. Pat. No. 5,266,573), XL-518 (also know as GDC-0973, Cas No. 1029872-29-4, available from ACC Corp.); Selumetinib (5-[(4-bromo-2-chlorophenyl)amino]-4-fluoro-N-(2-hydroxyethoxy)-1-methyl-1H-benzimidazole-6-carboxamide, also known as AZD6244 or ARRY 142886, described in PCT Publication No. WO2003077914); 2-[(2-chloro-4-iodophenyl)amino]-Nyclopropylmethoxy)-3,4-difluoro-benzamide (also known as CI-1040 or PD184352 and described in PCT Publication No. WO2000035436); N-[(2R)-2,3-dihydroxypropoxy]-3,4-difluoro-2-[(2-fluoro-4-iodophenyl)amino]-benzamide (also known as PD0325901 and described in PCT Publication No. WO2002006213); 2,3-bis [amino[(2-aminophenyl)thio]methylene]-butanedinitrile (also known as U0126 and described in U.S. Pat. No. 2,779,780); N-[3,4-difluoro-2-[(2-fluoro-4-iodophenyl) amino]-6-methoxyphenyl]-1-[(2R)-2,3-dihydroxypropyl]-cyclopropanesulfonamide (also known as RDEA119 or BAY869766 and described in PCT Publication No.

WO2007014011); (3S,4R,5Z,8S,9S,11E)-14-(ethylamino)-8,9,16-trihydroxy-3,4-dimethyl-3,4,9,19-tetrahydro-1H-2-benzoxacyclotetradecine-1,7(8H)-dione] (also known as E6201 and described in PCT Publication No. WO2003076424); 2'-Amino-3'-methoxyflavone (also known as PD98059 available from Biaffin GmbH & Co., KG, Germany); AS-703026 (CAS No. 1204531-26-9); AZD-8330 (also known as ARRY-424704 or ARRY-704, CAS No. 1204531-17-8); ARRY-438162 (CAS No. 1073666-70-2); GSK-1120212 (CAS No. 1204531-25-8); RO-4987665 (CAS No. 1204531-24-7); and TAK-733; Antiresorptive agents, Bisphosphonates, Bone anabolic agents, Calcitonin, Calcium, Calcium salts, Estrogen analogs, Raloxifene, RANKL inhibitors, Sodium fluoride, Strontium ranelate, Teriparatide, and Vitamin D.

The dosages of the additional treatments and RNAi agents can be easily determined by one of ordinary skill in the art, and as described herein.

Dosages and Effective Amounts of RNAi Agents

The RNAi agents of the present disclosure are administered in a dosage of a therapeutically effective amount to a patient in need thereof.

An "effective amount" or a "therapeutically effective amount" is an amount that treats a disease or medical condition of an individual, or, more generally, provides a nutritional, physiological or medical benefit to an individual. As used herein, the phrases "therapeutically effective amount" and "prophylactically effective amount" refer to an amount that provides a therapeutic benefit in the treatment, prevention, or management of pathological processes mediated by Beta-Catenin expression or an overt symptom of pathological processes mediated by Beta-Catenin expression. The specific amount that is therapeutically effective can be readily determined by an ordinary medical practitioner, and may vary depending on factors known in the art, such as, for example, the type of pathological processes mediated by Beta-Catenin expression, the patient's history and age, the stage of pathological processes mediated by Beta-Catenin expression, and the administration of other agents that inhibit pathological processes mediated by Beta-Catenin expression.

In various embodiments of the present disclosure, the patient is at least about 1, 3, 6, or 9 months, or 1, 5, 10, 20, 30, 40, 50, 55, 60, 65, 70, or 75 years of age. In various embodiments of the present disclosure, the patient is no more than about 1, 3, 6, or 9 months, or 1, 5, 10, 20, 30, 40, 50, 55, 60, 65, 70, 75, 80, 90, or 100 years of age. In various embodiments the patient has a body weight of at least about 5, 10, 15, 20, 30, 40, 50, 60, 70, 80, 90, 100, 120, 140, 160, 180, 200, 220, 240, 260, 280, 300, 320, 340, 360, 380 or 400 lbs. In various embodiments of the present disclosure, the patient has a body weight of no more than about 5, 10, 15, 20, 30, 40, 50, 60, 70, 80, 90, 100, 120, 140, 160, 180, 200, 220, 240, 260, 280, 300, 320, 340, 360, 380 or 400 lbs.

In various embodiments of the present disclosure, the dosage [measuring only the active ingredient(s)] can be at least about 1, 5, 10, 25, 50, 100, 200, 250, 300, 250, 400, 450, 500, 550, 600, 650, 700, 750, 800, 850, 900, 950 or 1000 ng, 1, 5, 10, 25, 50, 100, 200, 250, 300, 250, 400, 450, 500, 550, 600, 650, 700, 750, 800, 850, 900, 950 or 1000 micrograms, 1, 5, 10, 25, 50, 100, 200, 250, 300, 250, 400, 450, 500, 550, 600, 650, 700, 750, 800, 850, 900, 950 or 1000 mg. In various embodiments of the present disclosure, the dosage can be no more than about 10, 25, 50, 100, 200, 250, 300, 250, 400, 450, 500, 550, 600, 650, 700, 750, 800, 850, 900, 950 or 1000 mg. In various embodiments of the present disclosure, the dosage can be administered at least more than once a day, daily, more than once a weekly, weekly, bi-weekly, monthly, and/or every 2, 3, 4, 5, 6, 7, 8, 9, 10, 11 or 12 months, or a combination thereof.

In various embodiments of the present disclosure, the dosage is correlated to the body weight or body surface area of the individual. The actual dosage level can be varied to obtain an amount of active agent which is effective for a particular patient, composition and mode of administration, without being toxic to the patient. The selected dose will depend on a variety of pharmacokinetic factors, including the activity of the particular RNAi agent employed, the route of administration, the rate of excretion of the RNAi agent, the duration of the treatment, other drugs, compounds and/or materials used in combination with the RNAi agent, the age, sex, weight, condition, general health and prior medical history of the patient, and like factors well known in the medical arts. A physician or veterinarian having ordinary skill in the art can readily determine the effective amount of the RNAi agent required. A suitable dose will be that amount which is the lowest dose effective to produce a therapeutic effect, or a dose low enough to produce a therapeutic effect without causing side effects.

In addition to a therapeutically-effective dosage of one or more RNAi agents to Beta-Catenin, the pharmaceutical compositions of the present disclosure can comprise or be used in conjunction with an additional disease treatment which works synergistically with the RNAi agent. For example, the pharmaceutical composition can comprise an additional antagonist to Beta-Catenin.

Additional Embodiments of RNAi Agents to Beta-Catenin

In a particular embodiment, the present disclosure encompasses a composition comprising one or more Beta-Catenin RNAi agents. In one embodiment, the present disclosure comprises a RNAi agent comprising a sense strand and an anti-sense strand. In one embodiment, the anti-sense strand consists of, consists essentially of, or comprises the sequence of the anti-sense strand of, a RNAi agent listed in Tables 1, 2, 3, 4, 5, 6, 7, 8 and/or 9. In one embodiment, the anti-sense strand consists of, consists essentially of, or comprises a sequence of at least 15 contiguous nt with 0, 1, 2, or 3 mismatches from that of, the anti-sense strand of any RNAi agent listed in Tables 1, 2, 3, 4, 5, 6, 7, 8 and/or 9. In one embodiment, the anti-sense strand consists of the sequence of the anti-sense strand of a RNAi agent listed in Tables 1, 2, 3, 4, 5, 6, 7, 8 and/or 9, and further comprises 0, 1, 2, 3, 4, 5, 6, 7, 8, 9, or 10 nucleotides. In one embodiment, the anti-sense strand consists of a sequence with 0, 1, 2, or 3 mismatches from that of the anti-sense strand of a RNAi agent listed in Tables 1, 2, 3, 4, 5, 6, 7, 8 and/or 9, and further comprises 0, 1, 2, 3, 4, 5, 6, 7, 8, 9, or 10 nucleotides.

In various embodiments of the present disclosure, the composition of the claimed disclosure has the proviso that it does not comprise any particular individual RNAi agent listed in Tables 1, 2 or 3. In various embodiments of the present disclosure, the RNAi agent to Beta-Catenin has the proviso that it does not have the sequence of any Beta-Catenin RNAi agent disclosed in the patent or scientific literature, e.g., WO 2006/086772, US 2007 0207974, US 2007 0042381, US 2005 0255487, US 2007/0275914, US 2007 0039072, US 2006 0193870, or US 2008 0113351.

Additional Embodiments of RNAi Agents

In another particular embodiment, the RNAi agent comprises any of the RNAi agents listed in Table 1, and modified and unmodified variants thereof.

In another particular embodiment, the RNAi agent comprises the sense strand of any of the RNAi agents listed in Tables 1, 2, 3, 4, 5, 6, 7, 8 and/or 9, and modified and unmodified variants thereof.

In another particular embodiment, the RNAi agent comprises the anti-sense strand of any of the RNAi agents listed in Tables 1, 2, 3, 4, 5, 6, 7, 8 and/or 9, and modified and unmodified variants thereof.

In another particular embodiment, the RNAi agent comprises a sense strand with a sequence consisting of that of the sense strand of any of the RNAi agents listed in Tables 1, 2, 3, 4, 5, 6, 7, 8 and/or 9 and modified and unmodified variants thereof.

In another particular embodiment, the RNAi agent comprises an anti-sense strand with a sequence consisting of that of the anti-sense strand any of the RNAi agents listed in Tables 1, 2, 3, 4, 5, 6, 7, 8 and/or 9, and modified and unmodified variants thereof.

In another particular embodiment, the RNAi agent comprises a sense stand with a sequence consisting of that of the sense strand and/or an anti-sense strand with a sequence consisting of that of the anti-sense strand of any RNAi agents listed in Tables 1, 2, 3, 4, 5, 6, 7, 8 and/or 9.

In another particular embodiment, the RNAi agent has a sequence consisting of that of any of the RNAi agents listed in Tables 1, 2, 3, 4, 5, 6, 7, 8 and/or 9, and modified and unmodified variants thereof.

Embodiments Comprising One or More Efficacious RNAi Agents to Beta-Catenin

In various embodiments of the present disclosure, the present disclosure comprises a RNAi agent demonstrating at least about 40, 50, 60, 70, 80, 90 or 95% knockdown (no more than about 60, 50, 40, 30, 20, 10, or 5% residual gene activity, respectively) of the Beta-Catenin gene at an in vitro concentration of 10 or 0.1 nM in HeLa cells.

In various embodiments of the present disclosure, the composition comprises one or more RNAi agents capable of a Fold-Change at 10 nM at 24 hr of ≤0.05, ≤0.10, ≤0.20, ≤0.30, ≤0.40 (indicating a Beta-Catenin gene knock-down of at least 95, 90, 80, 70, or 60%, respectively, at a concentration of 10 nM at 24 hrs in HeLa cells). RNAi agents capable of these levels of activity are disclosed in the Tables herein.

Embodiments Comprising One or More Efficacious RNAi Agents to Beta-Catenin

In various embodiments of the present disclosure, the composition comprises one or more RNAi agents capable of a Fold-Change at 0.1 nM at 120 hr of ≤0.30, ≤0.20, or ≤0.10 (indicating a Beta-Catenin gene knock-down of at least 70, 80, or 90%, respectively, at a concentration of 0.1 nM at 120 hrs in HeLa cells). RNAi agents capable of these levels of activity are disclosed in the Tables herein.

Various Embodiments Comprising One or More RNAi Agents to Beta-Catenin with Low EC50

In various embodiments of the present disclosure, the composition comprises one or more RNAi agents capable of mediating 50% gene knockdown (EC50) of Beta-Catenin at a low concentration in HeLa cells. For many of the RNAi agents listed herein, an estimated EC50 was calculated. Cells were treated at 10 nM, 1 nM, 0.1 nM, 0.01 nM, and 0.001 nM of RNAi agent, and the data fit to a curve. The indicated EC50 is an estimated EC50 calculated from available data that is expected to give 50% gene knock-down of Beta-Catenin in HeLa cells. In various embodiments of the present disclosure, the composition comprises one or more RNAi agents capable of mediating 50% gene knockdown (EC50) at 100, 75, 50, 25, 10, 5, 2.5, 1, 0.75, 0.5, 0.25, 0.2, 0.12, 0.1, 0.09, 0.08, 0.07, 0.06, 0.05, 0.04, 0.03, or 0.02 nM or less in HeLa cells. RNAi agents capable of these levels of activity are disclosed in the Tables herein.

Specific Embodiments of RNAi Agents to Beta-Catenin

In one embodiment, the present disclosure pertains to: a composition comprising any one or more of: a RNAi agent comprising a sense strand and an anti-sense strand, wherein the anti-sense strand comprises at least 15 contiguous nucleotides differing by 0, 1, 2, or 3 nucleotides from the anti-sense strand of: any RNAi agent from Tables 1, 2, 3, 4, 5, 6, 7, 8 and/or 9 and modified or unmodified variants thereof.

In one embodiment, the composition comprises any one or more of: a RNAi agent comprising a sense strand and an anti-sense strand, wherein the anti-sense strand comprises at least 15 contiguous nucleotides differing by 0 nucleotides from the anti-sense strand of any RNAi agent from Tables 1, 2, 3, 4, 5, 6, 7, 8 and/or 9, and modified and unmodified variants thereof.

In one embodiment, the present disclosure pertains to a composition comprising any one or more of: any RNAi agent from Tables 1, 2, 3, 4, 5, 6, 7, 8 and/or 9, and modified and unmodified variants thereof.

In one embodiment, the present disclosure pertains to a composition comprising any one or more of: a RNAi agent comprising an anti-sense strand comprising the sequence of the anti-sense strand of any RNAi agent from Tables 1, 2, 3, 4, 5, 6, 7, 8 and/or 9, and modified and unmodified variants thereof.

In one embodiment, the present disclosure pertains to a composition comprising any one or more of: a RNAi agent comprises an anti-sense strand consisting of the sequence of the anti-sense strand of any RNAi agent from Tables 1, 2, 3, 4, 5, 6, 7, 8 and/or 9, and modified and unmodified variants thereof.

In one embodiment, the present disclosure pertains to a composition comprising any one or more of: a RNAi agent comprising a first strand and a second strand, wherein the sequence of the first strand is the second of the first strand of any RNAi agent from Tables 1, 2, 3, 4, 5, 6, 7, 8 and/or 9, and modified and unmodified variants thereof.

In one embodiment, the present disclosure pertains to a composition comprising any one or more of: a RNAi agent comprising a first and a second strand, wherein the sequences of the first and the second strand are the sequences of the first and second strand of any RNAi agent from Tables 1, 2, 3, 4, 5, 6, 7, 8 and/or 9, and modified and unmodified variants thereof.

In one embodiment, the present disclosure pertains to a composition comprising any one or more of: a RNAi agent comprising a first strand and a second strand, wherein the sequence of the first strand is the second of the first strand of any RNAi agent from Tables 1, 2, 3, 4, 5, 6, 7, 8 and/or 9, and modified and unmodified variants thereof, wherein the first and/or second strand further comprise up to about 20 additional nucleotides.

Additional Embodiments of Specific RNAi Agents to Beta-Catenin

In one embodiment, the present disclosure comprises a RNAi agent comprising a first strand and a second strand, wherein the first strand comprises at least 15 contiguous nucleotides differing by 0, 1, 2, or 3 nt from the sequence of the first strand of any RNAi agent from Tables 1, 2, 3, 4, 5, 6, 7, 8 and/or 9, or modified or unmodified variants thereof.

Thus, in various embodiments, the present disclosure pertains to a composition comprising any one or more of the following:

A RNAi agent comprising: a first strand and a second strand, wherein the first strand comprises at least 15 contiguous nucleotides differing by 0, 1, 2, or 3 nt from the sequence of the first strand of: AD-26104, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26063, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26082, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26034, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26091, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26047, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26651, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26696, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26109, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25941, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26028, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26652, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26742, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26921, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18893, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18983, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25950, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25951, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26042, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26043, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26673, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26704, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26068, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26183, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26700, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26701, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25942, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26076, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26031, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26210, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26664, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26691, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26740, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19765, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26158, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26180, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26078, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25894, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25964, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26156, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26670, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26743, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25890, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26044, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26685, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26731, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26800, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26066, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26682, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26684, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26757, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26788, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18963, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19076, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25943, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26052, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26665, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26746, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18974, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25938, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25944, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26178, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26669, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26730, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26825, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25956, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26822, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26108, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26752, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26779, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25891, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26101, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26181, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26218, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26660, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18966, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19074, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26179, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26722, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26768, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26920, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26020, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26713, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26727, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26808, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25958, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26105, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26674, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26781, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26801, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26813, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26816, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25945, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26203, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26021, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26040, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26069, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26134, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26702, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18933, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26690, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26698, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25910, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26747, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26810, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26083, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26061, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26904, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18903, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18980, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26202, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26679, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26719, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26758, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26783, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26902, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18892, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18897, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25902, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26705, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26782, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19082, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26176, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26196, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26199, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26678, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26683, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26729, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26804, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26900, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25914, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26060, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26763, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18902, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18914, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26100, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26128, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26193, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26765, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25960, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26018, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25893, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26823, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25940, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26190, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26675, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26797, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26916, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26755, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26901, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19004, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19009, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26148, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26186, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26737, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25955, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26029, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26131, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18894, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18939, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26654, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18929, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26135, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26774, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26780, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26819, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26918, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19050, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18994, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26769, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26666, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26784, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18969, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18986, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25929, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25932, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26095, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26908, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26071, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26912, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19054, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25918, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26903, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25931, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26146, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26200, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26917, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26794, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26910, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25939, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26032, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26776, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26806, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26748, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26725, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18958, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26672, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26905, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19056, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19762, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26919, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18946, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19066, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19746, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26057, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26073, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26689, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19008, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26026, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26761, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19752, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18981, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18927, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19753, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25907, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26671, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19080, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26075, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26681, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18976, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25900, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26126, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26688, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25912, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25930, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18995, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26802, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25892, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25947, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26088, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26098, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26778, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26215, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26739, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18950, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25949, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26141, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18961, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25957, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26826, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25963, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26019, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26035, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25946, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26714, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26022, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26096, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26132, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26062, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18991, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26164, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26209, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25895, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25933, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26017, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19749, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26653, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26759, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25924, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26153, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25953, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26764, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26790, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-20124, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25919, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18913, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26211, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18936, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25898, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26741, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19043, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26079, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19000, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25911, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26786, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19069, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26037, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26723, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19067, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25928, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26677, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19006, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19758, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26913, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25917, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26189, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26787, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26707, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26094, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26097, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26699, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26756, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26720, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25926, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26212, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26687, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26753, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18982, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18908, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18968, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25948, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26188, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26708, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25961, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26803, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19741, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26056, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25959, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26059, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26102, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26106, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26744, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26099, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26170, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19012, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26198, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26766, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18951, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18975, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26749, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18911, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26906, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-19747, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18960, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-25909, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26184, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26077, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26680, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26085, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18926, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18945, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26703, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26911, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26661, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-18905, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: AD-26142, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_1245, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_1249, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_1250, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_1450, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_1545, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_1755, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_1814, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_1816, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_1974, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_2202, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_2425, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_254, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_3146, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_3169, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_3196, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_3477, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_703, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_709, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_865, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_889, or modified or unmodified variants thereof.

A RNAi agent comprising: a first strand and a second strand, wherein the first strand comprises at least 15 contiguous nucleotides differing by 0, 1, 2, or 3 nt from the sequence of the first strand of: Set1_895, or modified or unmodified variants thereof.

In various embodiments, the first and second strand can be either the sense and anti-sense strand, or the anti-sense and sense strand.

Additional Embodiments of Specific RNAi Agents to Beta-Catenin

In one embodiment, the present disclosure comprises a RNAi agent comprising an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of any RNAi in Tables 1, 2, 3, 4, 5, 6, 7, 8 and/or 9, and modified and unmodified variants thereof.

Thus, in various embodiments, the present disclosure pertains to a composition comprising any one or more of the following:

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26104, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26063, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26082, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26034, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26091, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26047, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26651, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26696, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26109, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25941, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26028, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26652, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26742, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26921, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18893, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18983, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25950, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25951, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26042, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26043, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26673, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26704, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26068, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26183, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26700, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26701, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25942, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26076, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26031, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26210, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26664, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26691, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26740, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19765, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26158, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26180, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26078, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25894, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25964, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26156, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26670, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26743, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25890, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26044, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26685, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26731, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26800, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26066, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26682, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26684, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26757, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26788, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18963, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19076, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25943, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26052, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26665, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26746, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18974, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25938, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25944, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26178, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26669, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26730, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26825, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25956, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26822, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26108, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26752, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26779, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25891, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26101, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26181, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26218, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26660, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18966, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19074, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26179, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26722, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26768, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26920, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26020, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26713, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26727, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26808, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25958, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26105, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26674, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26781, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26801, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26813, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26816, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25945, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26203, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26021, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26040, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26069, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26134, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26702, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18933, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26690, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26698, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25910, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26747, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26810, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26083, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26061, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26904, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18903, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18980, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26202, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26679, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26719, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26758, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26783, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26902, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18892, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18897, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25902, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26705, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26782, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19082, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26176, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26196, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26199, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26678, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26683, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26729, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26804, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26900, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25914, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26060, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26763, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18902, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18914, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26100, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26128, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26193, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26765, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25960, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26018, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25893, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26823, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25940, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26190, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26675, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26797, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26916, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26755, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26901, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19004, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19009, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26148, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26186, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26737, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25955, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26029, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26131, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18894, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18939, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26654, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18929, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26135, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26774, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26780, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26819, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26918, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19050, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18994, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26769, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26666, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26784, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18969, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18986, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25929, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25932, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26095, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26908, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26071, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26912, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19054, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25918, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26903, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25931, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26146, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26200, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26917, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26794, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26910, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25939, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26032, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26776, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26806, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26748, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26725, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18958, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26672, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26905, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19056, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19762, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26919, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18946, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19066, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19746, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26057, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26073, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26689, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19008, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26026, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26761, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19752, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18981, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18927, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19753, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25907, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26671, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19080, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26075, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26681, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18976, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25900, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26126, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26688, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25912, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25930, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18995, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26802, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25892, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25947, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26088, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26098, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26778, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26215, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26739, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18950, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25949, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26141, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18961, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25957, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26826, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25963, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26019, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26035, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25946, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26714, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26022, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26096, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26132, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26062, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18991, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26164, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26209, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25895, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25933, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26017, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19749, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26653, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26759, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25924, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26153, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25953, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26764, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26790, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-20124, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25919, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18913, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26211, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18936, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25898, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26741, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19043, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26079, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19000, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25911, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26786, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19069, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26037, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26723, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19067, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25928, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26677, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19006, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19758, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26913, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25917, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26189, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26787, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26707, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26094, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26097, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26699, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26756, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26720, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25926, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26212, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26687, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26753, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18982, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18908, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18968, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25948, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26188, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26708, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25961, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26803, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19741, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26056, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25959, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26059, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26102, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26106, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26744, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26099, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26170, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19012, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26198, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26766, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18951, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18975, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26749, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18911, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26906, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-19747, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18960, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-25909, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26184, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26077, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26680, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26085, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18926, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18945, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26703, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26911, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26661, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-18905, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of AD-26142, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_1245, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_1249, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_1250, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_1450, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_1545, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_1755, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_1814, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_1816, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_1974, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_2202, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_2425, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_254, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_3146, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_3169, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_3196, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_3477, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_703, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_709, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_865, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_889, or modified or unmodified variants thereof.

A RNAi agent comprising: an anti-sense strand comprising at least 15 contiguous nucleotides differing by 0, 1, 2, or 3 nt from the sequence of the anti-sense strand, and/or a sense strand comprising at least 15 contiguous nucleotides differing by 0, 1, 2, or 3 nt from the sequence of the sense strand, of Set1_895, or modified or unmodified variants thereof.

Additional Embodiments Encompassing Specific RNAi Agents to Beta-Catenin

In various embodiments, the present disclosure pertains to a composition comprising one or more of the following:

A RNAi agent comprising a sense strand and an anti-sense strand, wherein the sequence of the anti-sense strand is the sequence of the anti-sense strand of AD-26104.

A RNAi agent comprising a sense strand and an anti-sense strand, wherein the sequence of the anti-sense strand is the sequence of the anti-sense strand of AD-26063.

A RNAi agent comprising a sense strand and an anti-sense strand, wherein the sequence of the anti-sense strand is the sequence of the anti-sense strand of AD-26082.

A RNAi agent comprising a sense strand and an anti-sense strand, wherein the sequence of the anti-sense strand is the sequence of the anti-sense strand of AD-26034.

A RNAi agent comprising a sense strand and an anti-sense strand, wherein the sequence of the anti-sense strand is the sequence of the anti-sense strand of AD-26091.

A RNAi agent comprising a sense strand and an anti-sense strand, wherein the sequence of the anti-sense strand is the sequence of the anti-sense strand of AD-26047.

A RNAi agent comprising a sense strand and an anti-sense strand, wherein the sequence of the anti-sense strand is the sequence of the anti-sense strand of AD-26651.

A RNAi agent comprising a sense strand and an anti-sense strand, wherein the sequence of the anti-sense strand is the sequence of the anti-sense strand of AD-26696.

A RNAi agent comprising a sense strand and an anti-sense strand, wherein the sequence of the anti-sense strand is the sequence of the anti-sense strand of AD-26109.

A RNAi agent comprising a sense strand and an anti-sense strand, wherein the sequence of the anti-sense strand is the sequence of the anti-sense strand of AD-25941.

A RNAi agent comprising a sense strand and an anti-sense strand, wherein the sequence of the anti-sense strand is the sequence of the anti-sense strand of AD-26028.

A RNAi agent comprising a sense strand and an anti-sense strand, wherein the sequence of the anti-sense strand is the sequence of the anti-sense strand of AD-26652.

A RNAi agent comprising a sense strand and an anti-sense strand, wherein the sequence of the anti-sense strand is the sequence of the anti-sense strand of AD-26742.

A RNAi agent comprising a sense strand and an anti-sense strand, wherein the sequence of the anti-sense strand is the sequence of the anti-sense strand of AD-26921.

A RNAi agent comprising a sense strand and an anti-sense strand, wherein the sequence of the anti-sense strand is the sequence of the anti-sense strand of AD-18893.

A RNAi agent comprising a sense strand and an anti-sense strand, wherein the sequence of the anti-sense strand is the sequence of the anti-sense strand of AD-18983.

A RNAi agent comprising a sense strand and an anti-sense strand, wherein the sequence of the anti-sense strand is the sequence of the anti-sense strand of AD-25950.

A RNAi agent comprising a sense strand and an anti-sense strand, wherein the sequence of the anti-sense strand is the sequence of the anti-sense strand of AD-25951.

A RNAi agent comprising a sense strand and an anti-sense strand, wherein the sequence of the anti-sense strand is the sequence of the anti-sense strand of AD-26042.

A RNAi agent comprising a sense strand and an anti-sense strand, wherein the sequence of the anti-sense strand is the sequence of the anti-sense strand of AD-26043.

A RNAi agent comprising a sense strand and an anti-sense strand, wherein the sequence of the anti-sense strand is the sequence of the anti-sense strand of AD-26673.

A RNAi agent comprising a sense strand and an anti-sense strand, wherein the sequence of the anti-sense strand is the sequence of the anti-sense strand of AD-26704.

A RNAi agent comprising a sense strand and an anti-sense strand, wherein the sequence of the anti-sense strand is the sequence of the anti-sense strand of AD-26068.

A RNAi agent comprising a sense strand and an anti-sense strand, wherein the sequence of the anti-sense strand is the sequence of the anti-sense strand of AD-26183.

A RNAi agent comprising a sense strand and an anti-sense strand, wherein the sequence of the anti-sense strand is the sequence of the anti-sense strand of AD-26700.

A RNAi agent comprising a sense strand and an anti-sense strand, wherein the sequence of the anti-sense strand is the sequence of the anti-sense strand of AD-26701.

A RNAi agent comprising a sense strand and an anti-sense strand, wherein the sequence of the anti-sense strand is the sequence of the anti-sense strand of AD-25942.

A RNAi agent comprising a sense strand and an anti-sense strand, wherein the sequence of the anti-sense strand is the sequence of the anti-sense strand of AD-26076.

A RNAi agent comprising a sense strand and an anti-sense strand, wherein the sequence of the anti-sense strand is the sequence of the anti-sense strand of AD-26031.

A RNAi agent comprising a sense strand and an anti-sense strand, wherein the sequence of the anti-sense strand is the sequence of the anti-sense strand of AD-26210.

A RNAi agent comprising a sense strand and an anti-sense strand, wherein the sequence of the anti-sense strand is the sequence of the anti-sense strand of AD-26664.

A RNAi agent comprising a sense strand and an anti-sense strand, wherein the sequence of the anti-sense strand is the sequence of the anti-sense strand of AD-26691.

A RNAi agent comprising a sense strand and an anti-sense strand, wherein the sequence of the anti-sense strand is the sequence of the anti-sense strand of AD-26740.

A RNAi agent comprising a sense strand and an anti-sense strand, wherein the sequence of the anti-sense strand is the sequence of the anti-sense strand of AD-19765.

A RNAi agent comprising a sense strand and an anti-sense strand, wherein the sequence of the anti-sense strand is the sequence of the anti-sense strand of AD-26158.

A RNAi agent comprising a sense strand and an anti-sense strand, wherein the sequence of the anti-sense strand is the sequence of the anti-sense strand of AD-26180.

A RNAi agent comprising a sense strand and an anti-sense strand, wherein the sequence of the anti-sense strand is the sequence of the anti-sense strand of AD-26078.

A RNAi agent comprising a sense strand and an anti-sense strand, wherein the sequence of the anti-sense strand is the sequence of the anti-sense strand of AD-25894.

A RNAi agent comprising a sense strand and an anti-sense strand, wherein the sequence of the anti-sense strand is the sequence of the anti-sense strand of AD-25964.

A RNAi agent comprising a sense strand and an anti-sense strand, wherein the sequence of the anti-sense strand is the sequence of the anti-sense strand of AD-26156.

A RNAi agent comprising a sense strand and an anti-sense strand, wherein the sequence of the anti-sense strand is the sequence of the anti-sense strand of AD-26670.

A RNAi agent comprising a sense strand and an anti-sense strand, wherein the sequence of the anti-sense strand is the sequence of the anti-sense strand of AD-26743.

A RNAi agent comprising a sense strand and an anti-sense strand, wherein the sequence of the anti-sense strand is the sequence of the anti-sense strand of AD-25890.

A RNAi agent comprising a sense strand and an anti-sense strand, wherein the sequence of the anti-sense strand is the sequence of the anti-sense strand of AD-26044.

A RNAi agent comprising a sense strand and an anti-sense strand, wherein the sequence of the anti-sense strand is the sequence of the anti-sense strand of AD-26685.

A RNAi agent comprising a sense strand and an anti-sense strand, wherein the sequence of the anti-sense strand is the sequence of the anti-sense strand of AD-26731.

A RNAi agent comprising a sense strand and an anti-sense strand, wherein the sequence of the anti-sense strand is the sequence of the anti-sense strand of AD-26800.

A RNAi agent comprising a sense strand and an anti-sense strand, wherein the sequence of the anti-sense strand is the sequence of the anti-sense strand of AD-26066.

A RNAi agent comprising a sense strand and an anti-sense strand, wherein the sequence of the anti-sense strand is the sequence of the anti-sense strand of AD-26682.

A RNAi agent comprising a sense strand and an anti-sense strand, wherein the sequence of the anti-sense strand is the sequence of the anti-sense strand of AD-26684.

A RNAi agent comprising a sense strand and an anti-sense strand, wherein the sequence of the anti-sense strand is the sequence of the anti-sense strand of AD-26757.

A RNAi agent comprising a sense strand and an anti-sense strand, wherein the sequence of the anti-sense strand is the sequence of the anti-sense strand of AD-26788.

A RNAi agent comprising a sense strand and an anti-sense strand, wherein the sequence of the anti-sense strand is the sequence of the anti-sense strand of AD-18963.

A RNAi agent comprising a sense strand and an anti-sense strand, wherein the sequence of the anti-sense strand is the sequence of the anti-sense strand of AD-19076.

A RNAi agent comprising a sense strand and an anti-sense strand, wherein the sequence of the anti-sense strand is the sequence of the anti-sense strand of AD-25943.

A RNAi agent comprising a sense strand and an anti-sense strand, wherein the sequence of the anti-sense strand is the sequence of the anti-sense strand of AD-26052.

A RNAi agent comprising a sense strand and an anti-sense strand, wherein the sequence of the anti-sense strand is the sequence of the anti-sense strand of AD-26665.

A RNAi agent comprising a sense strand and an anti-sense strand, wherein the sequence of the anti-sense strand is the sequence of the anti-sense strand of AD-26746.

A RNAi agent comprising a sense strand and an anti-sense strand, wherein the sequence of the anti-sense strand is the sequence of the anti-sense strand of AD-18974.

A RNAi agent comprising a sense strand and an anti-sense strand, wherein the sequence of the anti-sense strand is the sequence of the anti-sense strand of AD-25938.

A RNAi agent comprising a sense strand and an anti-sense strand, wherein the sequence of the anti-sense strand is the sequence of the anti-sense strand of AD-25944.

A RNAi agent comprising a sense strand and an anti-sense strand, wherein the sequence of the anti-sense strand is the sequence of the anti-sense strand of AD-26178.

A RNAi agent comprising a sense strand and an anti-sense strand, wherein the sequence of the anti-sense strand is the sequence of the anti-sense strand of AD-26669.

A RNAi agent comprising a sense strand and an anti-sense strand, wherein the sequence of the anti-sense strand is the sequence of the anti-sense strand of AD-26730.

A RNAi agent comprising a sense strand and an anti-sense strand, wherein the sequence of the anti-sense strand is the sequence of the anti-sense strand of AD-26825.

A RNAi agent comprising a sense strand and an anti-sense strand, wherein the sequence of the anti-sense strand is the sequence of the anti-sense strand of AD-25956.

A RNAi agent comprising a sense strand and an anti-sense strand, wherein the sequence of the anti-sense strand is the sequence of the anti-sense strand of AD-26822.

A RNAi agent comprising a sense strand and an anti-sense strand, wherein the sequence of the anti-sense strand is the sequence of the anti-sense strand of AD-26108.

A RNAi agent comprising a sense strand and an anti-sense strand, wherein the sequence of the anti-sense strand is the sequence of the anti-sense strand of AD-26752.

A RNAi agent comprising a sense strand and an anti-sense strand, wherein the sequence of the anti-sense strand is the sequence of the anti-sense strand of AD-26779.

A RNAi agent comprising a sense strand and an anti-sense strand, wherein the sequence of the anti-sense strand is the sequence of the anti-sense strand of AD-25891.

A RNAi agent comprising a sense strand and an anti-sense strand, wherein the sequence of the anti-sense strand is the sequence of the anti-sense strand of AD-26101.

A RNAi agent comprising a sense strand and an anti-sense strand, wherein the sequence of the anti-sense strand is the sequence of the anti-sense strand of AD-26181.

A RNAi agent comprising a sense strand and an anti-sense strand, wherein the sequence of the anti-sense strand is the sequence of the anti-sense strand of AD-26218.

A RNAi agent comprising a sense strand and an anti-sense strand, wherein the sequence of the anti-sense strand is the sequence of the anti-sense strand of AD-26660.

A RNAi agent comprising a sense strand and an anti-sense strand, wherein the sequence of the anti-sense strand is the sequence of the anti-sense strand of AD-18966.

A RNAi agent comprising a sense strand and an anti-sense strand, wherein the sequence of the anti-sense strand is the sequence of the anti-sense strand of AD-19074.

A RNAi agent comprising a sense strand and an anti-sense strand, wherein the sequence of the anti-sense strand is the sequence of the anti-sense strand of AD-26179.

A RNAi agent comprising a sense strand and an anti-sense strand, wherein the sequence of the anti-sense strand is the sequence of the anti-sense strand of AD-26722.

A RNAi agent comprising a sense strand and an anti-sense strand, wherein the sequence of the anti-sense strand is the sequence of the anti-sense strand of AD-26768.

A RNAi agent comprising a sense strand and an anti-sense strand, wherein the sequence of the anti-sense strand is the sequence of the anti-sense strand of AD-26920.

A RNAi agent comprising a sense strand and an anti-sense strand, wherein the sequence of the anti-sense strand is the sequence of the anti-sense strand of AD-26020.

A RNAi agent comprising a sense strand and an anti-sense strand, wherein the sequence of the anti-sense strand is the sequence of the anti-sense strand of AD-26713.

A RNAi agent comprising a sense strand and an anti-sense strand, wherein the sequence of the anti-sense strand is the sequence of the anti-sense strand of AD-26727.

A RNAi agent comprising a sense strand and an anti-sense strand, wherein the sequence of the anti-sense strand is the sequence of the anti-sense strand of AD-26808.

A RNAi agent comprising a sense strand and an anti-sense strand, wherein the sequence of the anti-sense strand is the sequence of the anti-sense strand of AD-25958.

A RNAi agent comprising a sense strand and an anti-sense strand, wherein the sequence of the anti-sense strand is the sequence of the anti-sense strand of AD-26105.

A RNAi agent comprising a sense strand and an anti-sense strand, wherein the sequence of the anti-sense strand is the sequence of the anti-sense strand of AD-26674.

A RNAi agent comprising a sense strand and an anti-sense strand, wherein the sequence of the anti-sense strand is the sequence of the anti-sense strand of AD-26781.

A RNAi agent comprising a sense strand and an anti-sense strand, wherein the sequence of the anti-sense strand is the sequence of the anti-sense strand of AD-26801.

A RNAi agent comprising a sense strand and an anti-sense strand, wherein the sequence of the anti-sense strand is the sequence of the anti-sense strand of AD-26813.

A RNAi agent comprising a sense strand and an anti-sense strand, wherein the sequence of the anti-sense strand is the sequence of the anti-sense strand of AD-26816.

A RNAi agent comprising a sense strand and an anti-sense strand, wherein the sequence of the anti-sense strand is the sequence of the anti-sense strand of AD-25945.

A RNAi agent comprising a sense strand and an anti-sense strand, wherein the sequence of the anti-sense strand is the sequence of the anti-sense strand of AD-26203.

A RNAi agent comprising a sense strand and an anti-sense strand, wherein the sequence of the anti-sense strand is the sequence of the anti-sense strand of AD-26021.

A RNAi agent comprising a sense strand and an anti-sense strand, wherein the sequence of the anti-sense strand is the sequence of the anti-sense strand of AD-26040.

A RNAi agent comprising a sense strand and an anti-sense strand, wherein the sequence of the anti-sense strand is the sequence of the anti-sense strand of AD-26069.

A RNAi agent comprising a sense strand and an anti-sense strand, wherein the sequence of the anti-sense strand is the sequence of the anti-sense strand of AD-26134.

A RNAi agent comprising a sense strand and an anti-sense strand, wherein the sequence of the anti-sense strand is the sequence of the anti-sense strand of AD-26702.

A RNAi agent comprising a sense strand and an anti-sense strand, wherein the sequence of the anti-sense strand is the sequence of the anti-sense strand of AD-18933.

A RNAi agent comprising a sense strand and an anti-sense strand, wherein the sequence of the anti-sense strand is the sequence of the anti-sense strand of AD-26690.

A RNAi agent comprising a sense strand and an anti-sense strand, wherein the sequence of the anti-sense strand is the sequence of the anti-sense strand of AD-26698.

A RNAi agent comprising a sense strand and an anti-sense strand, wherein the sequence of the anti-sense strand is the sequence of the anti-sense strand of AD-25910.

A RNAi agent comprising a sense strand and an anti-sense strand, wherein the sequence of the anti-sense strand is the sequence of the anti-sense strand of AD-26747.

A RNAi agent comprising a sense strand and an anti-sense strand, wherein the sequence of the anti-sense strand is the sequence of the anti-sense strand of AD-26810.

A RNAi agent comprising a sense strand and an anti-sense strand, wherein the sequence of the anti-sense strand is the sequence of the anti-sense strand of AD-26083.

A RNAi agent comprising a sense strand and an anti-sense strand, wherein the sequence of the anti-sense strand is the sequence of the anti-sense strand of AD-26061.

A RNAi agent comprising a sense strand and an anti-sense strand, wherein the sequence of the anti-sense strand is the sequence of the anti-sense strand of AD-26904.

A RNAi agent comprising a sense strand and an anti-sense strand, wherein the sequence of the anti-sense strand is the sequence of the anti-sense strand of AD-18903.

A RNAi agent comprising a sense strand and an anti-sense strand, wherein the sequence of the anti-sense strand is the sequence of the anti-sense strand of AD-18980.

A RNAi agent comprising a sense strand and an anti-sense strand, wherein the sequence of the anti-sense strand is the sequence of the anti-sense strand of AD-26202.

A RNAi agent comprising a sense strand and an anti-sense strand, wherein the sequence of the anti-sense strand is the sequence of the anti-sense strand of AD-26679.

A RNAi agent comprising a sense strand and an anti-sense strand, wherein the sequence of the anti-sense strand is the sequence of the anti-sense strand of AD-26719.

A RNAi agent comprising a sense strand and an anti-sense strand, wherein the sequence of the anti-sense strand is the sequence of the anti-sense strand of AD-26758.

A RNAi agent comprising a sense strand and an anti-sense strand, wherein the sequence of the anti-sense strand is the sequence of the anti-sense strand of AD-26783.

A RNAi agent comprising a sense strand and an anti-sense strand, wherein the sequence of the anti-sense strand is the sequence of the anti-sense strand of AD-26902.

A RNAi agent comprising a sense strand and an anti-sense strand, wherein the sequence of the anti-sense strand is the sequence of the anti-sense strand of AD-18892.

A RNAi agent comprising a sense strand and an anti-sense strand, wherein the sequence of the anti-sense strand is the sequence of the anti-sense strand of AD-18897.

A RNAi agent comprising a sense strand and an anti-sense strand, wherein the sequence of the anti-sense strand is the sequence of the anti-sense strand of AD-25902.

A RNAi agent comprising a sense strand and an anti-sense strand, wherein the sequence of the anti-sense strand is the sequence of the anti-sense strand of AD-26705.

A RNAi agent comprising a sense strand and an anti-sense strand, wherein the sequence of the anti-sense strand is the sequence of the anti-sense strand of AD-26782.

A RNAi agent comprising a sense strand and an anti-sense strand, wherein the sequence of the anti-sense strand is the sequence of the anti-sense strand of AD-19082.

A RNAi agent comprising a sense strand and an anti-sense strand, wherein the sequence of the anti-sense strand is the sequence of the anti-sense strand of AD-26176.

A RNAi agent comprising a sense strand and an anti-sense strand, wherein the sequence of the anti-sense strand is the sequence of the anti-sense strand of AD-26196.

A RNAi agent comprising a sense strand and an anti-sense strand, wherein the sequence of the anti-sense strand is the sequence of the anti-sense strand of AD-26199.

A RNAi agent comprising a sense strand and an anti-sense strand, wherein the sequence of the anti-sense strand is the sequence of the anti-sense strand of AD-26678.

A RNAi agent comprising a sense strand and an anti-sense strand, wherein the sequence of the anti-sense strand is the sequence of the anti-sense strand of AD-26683.

A RNAi agent comprising a sense strand and an anti-sense strand, wherein the sequence of the anti-sense strand is the sequence of the anti-sense strand of AD-26729.

A RNAi agent comprising a sense strand and an anti-sense strand, wherein the sequence of the anti-sense strand is the sequence of the anti-sense strand of AD-26804.

A RNAi agent comprising a sense strand and an anti-sense strand, wherein the sequence of the anti-sense strand is the sequence of the anti-sense strand of AD-26900.

A RNAi agent comprising a sense strand and an anti-sense strand, wherein the sequence of the anti-sense strand is the sequence of the anti-sense strand of AD-25914.

A RNAi agent comprising a sense strand and an anti-sense strand, wherein the sequence of the anti-sense strand is the sequence of the anti-sense strand of AD-26060.

A RNAi agent comprising a sense strand and an anti-sense strand, wherein the sequence of the anti-sense strand is the sequence of the anti-sense strand of AD-26763.

A RNAi agent comprising a sense strand and an anti-sense strand, wherein the sequence of the anti-sense strand is the sequence of the anti-sense strand of AD-18902.

A RNAi agent comprising a sense strand and an anti-sense strand, wherein the sequence of the anti-sense strand is the sequence of the anti-sense strand of AD-18914.

A RNAi agent comprising a sense strand and an anti-sense strand, wherein the sequence of the anti-sense strand is the sequence of the anti-sense strand of AD-26100.

A RNAi agent comprising a sense strand and an anti-sense strand, wherein the sequence of the anti-sense strand is the sequence of the anti-sense strand of AD-26128.

A RNAi agent comprising a sense strand and an anti-sense strand, wherein the sequence of the anti-sense strand is the sequence of the anti-sense strand of AD-26193.

A RNAi agent comprising a sense strand and an anti-sense strand, wherein the sequence of the anti-sense strand is the sequence of the anti-sense strand of AD-26765.

A RNAi agent comprising a sense strand and an anti-sense strand, wherein the sequence of the anti-sense strand is the sequence of the anti-sense strand of AD-25960.

A RNAi agent comprising a sense strand and an anti-sense strand, wherein the sequence of the anti-sense strand is the sequence of the anti-sense strand of AD-26018.

A RNAi agent comprising a sense strand and an anti-sense strand, wherein the sequence of the anti-sense strand is the sequence of the anti-sense strand of AD-25893.

A RNAi agent comprising a sense strand and an anti-sense strand, wherein the sequence of the anti-sense strand is the sequence of the anti-sense strand of AD-26823.

A RNAi agent comprising a sense strand and an anti-sense strand, wherein the sequence of the anti-sense strand is the sequence of the anti-sense strand of AD-25940.

A RNAi agent comprising a sense strand and an anti-sense strand, wherein the sequence of the anti-sense strand is the sequence of the anti-sense strand of AD-26190.

A RNAi agent comprising a sense strand and an anti-sense strand, wherein the sequence of the anti-sense strand is the sequence of the anti-sense strand of AD-26675.

A RNAi agent comprising a sense strand and an anti-sense strand, wherein the sequence of the anti-sense strand is the sequence of the anti-sense strand of AD-26797.

A RNAi agent comprising a sense strand and an anti-sense strand, wherein the sequence of the anti-sense strand is the sequence of the anti-sense strand of AD-26916.

A RNAi agent comprising a sense strand and an anti-sense strand, wherein the sequence of the anti-sense strand is the sequence of the anti-sense strand of AD-26755.

A RNAi agent comprising a sense strand and an anti-sense strand, wherein the sequence of the anti-sense strand is the sequence of the anti-sense strand of AD-26901.

A RNAi agent comprising a sense strand and an anti-sense strand, wherein the sequence of the anti-sense strand is the sequence of the anti-sense strand of AD-19004.

A RNAi agent comprising a sense strand and an anti-sense strand, wherein the sequence of the anti-sense strand is the sequence of the anti-sense strand of AD-19009.

A RNAi agent comprising a sense strand and an anti-sense strand, wherein the sequence of the anti-sense strand is the sequence of the anti-sense strand of AD-26148.

A RNAi agent comprising a sense strand and an anti-sense strand, wherein the sequence of the anti-sense strand is the sequence of the anti-sense strand of AD-26186.

A RNAi agent comprising a sense strand and an anti-sense strand, wherein the sequence of the anti-sense strand is the sequence of the anti-sense strand of AD-26737.

A RNAi agent comprising a sense strand and an anti-sense strand, wherein the sequence of the anti-sense strand is the sequence of the anti-sense strand of AD-25955.

A RNAi agent comprising a sense strand and an anti-sense strand, wherein the sequence of the anti-sense strand is the sequence of the anti-sense strand of AD-26029.

A RNAi agent comprising a sense strand and an anti-sense strand, wherein the sequence of the anti-sense strand is the sequence of the anti-sense strand of AD-26131.

A RNAi agent comprising a sense strand and an anti-sense strand, wherein the sequence of the anti-sense strand is the sequence of the anti-sense strand of AD-18894.

A RNAi agent comprising a sense strand and an anti-sense strand, wherein the sequence of the anti-sense strand is the sequence of the anti-sense strand of AD-18939.

A RNAi agent comprising a sense strand and an anti-sense strand, wherein the sequence of the anti-sense strand is the sequence of the anti-sense strand of AD-26654.

A RNAi agent comprising a sense strand and an anti-sense strand, wherein the sequence of the anti-sense strand is the sequence of the anti-sense strand of AD-18929.

A RNAi agent comprising a sense strand and an anti-sense strand, wherein the sequence of the anti-sense strand is the sequence of the anti-sense strand of AD-26135.

A RNAi agent comprising a sense strand and an anti-sense strand, wherein the sequence of the anti-sense strand is the sequence of the anti-sense strand of AD-26774.

A RNAi agent comprising a sense strand and an anti-sense strand, wherein the sequence of the anti-sense strand is the sequence of the anti-sense strand of AD-26780.

A RNAi agent comprising a sense strand and an anti-sense strand, wherein the sequence of the anti-sense strand is the sequence of the anti-sense strand of AD-26819.

A RNAi agent comprising a sense strand and an anti-sense strand, wherein the sequence of the anti-sense strand is the sequence of the anti-sense strand of AD-26918.

A RNAi agent comprising a sense strand and an anti-sense strand, wherein the sequence of the anti-sense strand is the sequence of the anti-sense strand of AD-19050.

A RNAi agent comprising a sense strand and an anti-sense strand, wherein the sequence of the anti-sense strand is the sequence of the anti-sense strand of AD-18994.

A RNAi agent comprising a sense strand and an anti-sense strand, wherein the sequence of the anti-sense strand is the sequence of the anti-sense strand of AD-26769.

A RNAi agent comprising a sense strand and an anti-sense strand, wherein the sequence of the anti-sense strand is the sequence of the anti-sense strand of AD-26666.

A RNAi agent comprising a sense strand and an anti-sense strand, wherein the sequence of the anti-sense strand is the sequence of the anti-sense strand of AD-26784.

A RNAi agent comprising a sense strand and an anti-sense strand, wherein the sequence of the anti-sense strand is the sequence of the anti-sense strand of AD-18969.

A RNAi agent comprising a sense strand and an anti-sense strand, wherein the sequence of the anti-sense strand is the sequence of the anti-sense strand of AD-18986.

A RNAi agent comprising a sense strand and an anti-sense strand, wherein the sequence of the anti-sense strand is the sequence of the anti-sense strand of AD-25929.

A RNAi agent comprising a sense strand and an anti-sense strand, wherein the sequence of the anti-sense strand is the sequence of the anti-sense strand of AD-25932.

A RNAi agent comprising a sense strand and an anti-sense strand, wherein the sequence of the anti-sense strand is the sequence of the anti-sense strand of AD-26095.

A RNAi agent comprising a sense strand and an anti-sense strand, wherein the sequence of the anti-sense strand is the sequence of the anti-sense strand of AD-26908.

A RNAi agent comprising a sense strand and an anti-sense strand, wherein the sequence of the anti-sense strand is the sequence of the anti-sense strand of AD-26071.

A RNAi agent comprising a sense strand and an anti-sense strand, wherein the sequence of the anti-sense strand is the sequence of the anti-sense strand of AD-26912.

A RNAi agent comprising a sense strand and an anti-sense strand, wherein the sequence of the anti-sense strand is the sequence of the anti-sense strand of AD-19054.

A RNAi agent comprising a sense strand and an anti-sense strand, wherein the sequence of the anti-sense strand is the sequence of the anti-sense strand of AD-25918.

A RNAi agent comprising a sense strand and an anti-sense strand, wherein the sequence of the anti-sense strand is the sequence of the anti-sense strand of AD-26903.

A RNAi agent comprising a sense strand and an anti-sense strand, wherein the sequence of the anti-sense strand is the sequence of the anti-sense strand of AD-25931.

A RNAi agent comprising a sense strand and an anti-sense strand, wherein the sequence of the anti-sense strand is the sequence of the anti-sense strand of AD-26146.

A RNAi agent comprising a sense strand and an anti-sense strand, wherein the sequence of the anti-sense strand is the sequence of the anti-sense strand of AD-26200.

A RNAi agent comprising a sense strand and an anti-sense strand, wherein the sequence of the anti-sense strand is the sequence of the anti-sense strand of AD-26917.

A RNAi agent comprising a sense strand and an anti-sense strand, wherein the sequence of the anti-sense strand is the sequence of the anti-sense strand of AD-26794.

A RNAi agent comprising a sense strand and an anti-sense strand, wherein the sequence of the anti-sense strand is the sequence of the anti-sense strand of AD-26910.

A RNAi agent comprising a sense strand and an anti-sense strand, wherein the sequence of the anti-sense strand is the sequence of the anti-sense strand of AD-25939.

A RNAi agent comprising a sense strand and an anti-sense strand, wherein the sequence of the anti-sense strand is the sequence of the anti-sense strand of AD-26032.

A RNAi agent comprising a sense strand and an anti-sense strand, wherein the sequence of the anti-sense strand is the sequence of the anti-sense strand of AD-26776.

A RNAi agent comprising a sense strand and an anti-sense strand, wherein the sequence of the anti-sense strand is the sequence of the anti-sense strand of AD-26806.

A RNAi agent comprising a sense strand and an anti-sense strand, wherein the sequence of the anti-sense strand is the sequence of the anti-sense strand of AD-26748.

A RNAi agent comprising a sense strand and an anti-sense strand, wherein the sequence of the anti-sense strand is the sequence of the anti-sense strand of AD-26725.

A RNAi agent comprising a sense strand and an anti-sense strand, wherein the sequence of the anti-sense strand is the sequence of the anti-sense strand of AD-18958.

A RNAi agent comprising a sense strand and an anti-sense strand, wherein the sequence of the anti-sense strand is the sequence of the anti-sense strand of AD-26672.

A RNAi agent comprising a sense strand and an anti-sense strand, wherein the sequence of the anti-sense strand is the sequence of the anti-sense strand of AD-26905.

A RNAi agent comprising a sense strand and an anti-sense strand, wherein the sequence of the anti-sense strand is the sequence of the anti-sense strand of AD-19056.

A RNAi agent comprising a sense strand and an anti-sense strand, wherein the sequence of the anti-sense strand is the sequence of the anti-sense strand of AD-19762.

A RNAi agent comprising a sense strand and an anti-sense strand, wherein the sequence of the anti-sense strand is the sequence of the anti-sense strand of AD-26919.

A RNAi agent comprising a sense strand and an anti-sense strand, wherein the sequence of the anti-sense strand is the sequence of the anti-sense strand of AD-18946.

A RNAi agent comprising a sense strand and an anti-sense strand, wherein the sequence of the anti-sense strand is the sequence of the anti-sense strand of AD-19066.

A RNAi agent comprising a sense strand and an anti-sense strand, wherein the sequence of the anti-sense strand is the sequence of the anti-sense strand of AD-19746.

A RNAi agent comprising a sense strand and an anti-sense strand, wherein the sequence of the anti-sense strand is the sequence of the anti-sense strand of AD-26057.

A RNAi agent comprising a sense strand and an anti-sense strand, wherein the sequence of the anti-sense strand is the sequence of the anti-sense strand of AD-26073.

A RNAi agent comprising a sense strand and an anti-sense strand, wherein the sequence of the anti-sense strand is the sequence of the anti-sense strand of AD-26689.

A RNAi agent comprising a sense strand and an anti-sense strand, wherein the sequence of the anti-sense strand is the sequence of the anti-sense strand of AD-19008.

A RNAi agent comprising a sense strand and an anti-sense strand, wherein the sequence of the anti-sense strand is the sequence of the anti-sense strand of AD-26026.

A RNAi agent comprising a sense strand and an anti-sense strand, wherein the sequence of the anti-sense strand is the sequence of the anti-sense strand of AD-26761.

A RNAi agent comprising a sense strand and an anti-sense strand, wherein the sequence of the anti-sense strand is the sequence of the anti-sense strand of AD-19752.

A RNAi agent comprising a sense strand and an anti-sense strand, wherein the sequence of the anti-sense strand is the sequence of the anti-sense strand of AD-18981.

A RNAi agent comprising a sense strand and an anti-sense strand, wherein the sequence of the anti-sense strand is the sequence of the anti-sense strand of AD-18927.

A RNAi agent comprising a sense strand and an anti-sense strand, wherein the sequence of the anti-sense strand is the sequence of the anti-sense strand of AD-19753.

A RNAi agent comprising a sense strand and an anti-sense strand, wherein the sequence of the anti-sense strand is the sequence of the anti-sense strand of AD-25907.

A RNAi agent comprising a sense strand and an anti-sense strand, wherein the sequence of the anti-sense strand is the sequence of the anti-sense strand of AD-26671.

A RNAi agent comprising a sense strand and an anti-sense strand, wherein the sequence of the anti-sense strand is the sequence of the anti-sense strand of AD-19080.

A RNAi agent comprising a sense strand and an anti-sense strand, wherein the sequence of the anti-sense strand is the sequence of the anti-sense strand of AD-26075.

A RNAi agent comprising a sense strand and an anti-sense strand, wherein the sequence of the anti-sense strand is the sequence of the anti-sense strand of AD-26681.

A RNAi agent comprising a sense strand and an anti-sense strand, wherein the sequence of the anti-sense strand is the sequence of the anti-sense strand of AD-18976.

A RNAi agent comprising a sense strand and an anti-sense strand, wherein the sequence of the anti-sense strand is the sequence of the anti-sense strand of AD-25900.

A RNAi agent comprising a sense strand and an anti-sense strand, wherein the sequence of the anti-sense strand is the sequence of the anti-sense strand of AD-26126.

A RNAi agent comprising a sense strand and an anti-sense strand, wherein the sequence of the anti-sense strand is the sequence of the anti-sense strand of AD-26688.

A RNAi agent comprising a sense strand and an anti-sense strand, wherein the sequence of the anti-sense strand is the sequence of the anti-sense strand of AD-25912.

A RNAi agent comprising a sense strand and an anti-sense strand, wherein the sequence of the anti-sense strand is the sequence of the anti-sense strand of AD-25930.

A RNAi agent comprising a sense strand and an anti-sense strand, wherein the sequence of the anti-sense strand is the sequence of the anti-sense strand of AD-18995.

A RNAi agent comprising a sense strand and an anti-sense strand, wherein the sequence of the anti-sense strand is the sequence of the anti-sense strand of AD-26802.

A RNAi agent comprising a sense strand and an anti-sense strand, wherein the sequence of the anti-sense strand is the sequence of the anti-sense strand of AD-25892.

A RNAi agent comprising a sense strand and an anti-sense strand, wherein the sequence of the anti-sense strand is the sequence of the anti-sense strand of AD-25947.

A RNAi agent comprising a sense strand and an anti-sense strand, wherein the sequence of the anti-sense strand is the sequence of the anti-sense strand of AD-26088.

A RNAi agent comprising a sense strand and an anti-sense strand, wherein the sequence of the anti-sense strand is the sequence of the anti-sense strand of AD-26098.

A RNAi agent comprising a sense strand and an anti-sense strand, wherein the sequence of the anti-sense strand is the sequence of the anti-sense strand of AD-26778.

A RNAi agent comprising a sense strand and an anti-sense strand, wherein the sequence of the anti-sense strand is the sequence of the anti-sense strand of AD-26215.

A RNAi agent comprising a sense strand and an anti-sense strand, wherein the sequence of the anti-sense strand is the sequence of the anti-sense strand of AD-26739.

A RNAi agent comprising a sense strand and an anti-sense strand, wherein the sequence of the anti-sense strand is the sequence of the anti-sense strand of AD-18950.

A RNAi agent comprising a sense strand and an anti-sense strand, wherein the sequence of the anti-sense strand is the sequence of the anti-sense strand of AD-25949.

A RNAi agent comprising a sense strand and an anti-sense strand, wherein the sequence of the anti-sense strand is the sequence of the anti-sense strand of AD-26141.

A RNAi agent comprising a sense strand and an anti-sense strand, wherein the sequence of the anti-sense strand is the sequence of the anti-sense strand of AD-18961.

A RNAi agent comprising a sense strand and an anti-sense strand, wherein the sequence of the anti-sense strand is the sequence of the anti-sense strand of AD-25957.

A RNAi agent comprising a sense strand and an anti-sense strand, wherein the sequence of the anti-sense strand is the sequence of the anti-sense strand of AD-26826.

A RNAi agent comprising a sense strand and an anti-sense strand, wherein the sequence of the anti-sense strand is the sequence of the anti-sense strand of AD-25963.

A RNAi agent comprising a sense strand and an anti-sense strand, wherein the sequence of the anti-sense strand is the sequence of the anti-sense strand of AD-26019.

A RNAi agent comprising a sense strand and an anti-sense strand, wherein the sequence of the anti-sense strand is the sequence of the anti-sense strand of AD-26035.

A RNAi agent comprising a sense strand and an anti-sense strand, wherein the sequence of the anti-sense strand is the sequence of the anti-sense strand of AD-25946.

A RNAi agent comprising a sense strand and an anti-sense strand, wherein the sequence of the anti-sense strand is the sequence of the anti-sense strand of AD-26714.

A RNAi agent comprising a sense strand and an anti-sense strand, wherein the sequence of the anti-sense strand is the sequence of the anti-sense strand of AD-26022.

A RNAi agent comprising a sense strand and an anti-sense strand, wherein the sequence of the anti-sense strand is the sequence of the anti-sense strand of AD-26096.

A RNAi agent comprising a sense strand and an anti-sense strand, wherein the sequence of the anti-sense strand is the sequence of the anti-sense strand of AD-26132.

A RNAi agent comprising a sense strand and an anti-sense strand, wherein the sequence of the anti-sense strand is the sequence of the anti-sense strand of AD-26062.

A RNAi agent comprising a sense strand and an anti-sense strand, wherein the sequence of the anti-sense strand is the sequence of the anti-sense strand of AD-18991.

A RNAi agent comprising a sense strand and an anti-sense strand, wherein the sequence of the anti-sense strand is the sequence of the anti-sense strand of AD-26164.

A RNAi agent comprising a sense strand and an anti-sense strand, wherein the sequence of the anti-sense strand is the sequence of the anti-sense strand of AD-26209.

A RNAi agent comprising a sense strand and an anti-sense strand, wherein the sequence of the anti-sense strand is the sequence of the anti-sense strand of AD-25895.

A RNAi agent comprising a sense strand and an anti-sense strand, wherein the sequence of the anti-sense strand is the sequence of the anti-sense strand of AD-25933.

A RNAi agent comprising a sense strand and an anti-sense strand, wherein the sequence of the anti-sense strand is the sequence of the anti-sense strand of AD-26017.

A RNAi agent comprising a sense strand and an anti-sense strand, wherein the sequence of the anti-sense strand is the sequence of the anti-sense strand of AD-19749.

A RNAi agent comprising a sense strand and an anti-sense strand, wherein the sequence of the anti-sense strand is the sequence of the anti-sense strand of AD-26653.

A RNAi agent comprising a sense strand and an anti-sense strand, wherein the sequence of the anti-sense strand is the sequence of the anti-sense strand of AD-26759.

A RNAi agent comprising a sense strand and an anti-sense strand, wherein the sequence of the anti-sense strand is the sequence of the anti-sense strand of AD-25924.

A RNAi agent comprising a sense strand and an anti-sense strand, wherein the sequence of the anti-sense strand is the sequence of the anti-sense strand of AD-26153.

A RNAi agent comprising a sense strand and an anti-sense strand, wherein the sequence of the anti-sense strand is the sequence of the anti-sense strand of AD-25953.

A RNAi agent comprising a sense strand and an anti-sense strand, wherein the sequence of the anti-sense strand is the sequence of the anti-sense strand of AD-26764.

A RNAi agent comprising a sense strand and an anti-sense strand, wherein the sequence of the anti-sense strand is the sequence of the anti-sense strand of AD-26790.

A RNAi agent comprising a sense strand and an anti-sense strand, wherein the sequence of the anti-sense strand is the sequence of the anti-sense strand of AD-20124.

A RNAi agent comprising a sense strand and an anti-sense strand, wherein the sequence of the anti-sense strand is the sequence of the anti-sense strand of AD-25919.

A RNAi agent comprising a sense strand and an anti-sense strand, wherein the sequence of the anti-sense strand is the sequence of the anti-sense strand of AD-18913.

A RNAi agent comprising a sense strand and an anti-sense strand, wherein the sequence of the anti-sense strand is the sequence of the anti-sense strand of AD-26211.

A RNAi agent comprising a sense strand and an anti-sense strand, wherein the sequence of the anti-sense strand is the sequence of the anti-sense strand of AD-18936.

A RNAi agent comprising a sense strand and an anti-sense strand, wherein the sequence of the anti-sense strand is the sequence of the anti-sense strand of AD-25898.

A RNAi agent comprising a sense strand and an anti-sense strand, wherein the sequence of the anti-sense strand is the sequence of the anti-sense strand of AD-26741.

A RNAi agent comprising a sense strand and an anti-sense strand, wherein the sequence of the anti-sense strand is the sequence of the anti-sense strand of AD-19043.

A RNAi agent comprising a sense strand and an anti-sense strand, wherein the sequence of the anti-sense strand is the sequence of the anti-sense strand of AD-26079.

A RNAi agent comprising a sense strand and an anti-sense strand, wherein the sequence of the anti-sense strand is the sequence of the anti-sense strand of AD-19000.

A RNAi agent comprising a sense strand and an anti-sense strand, wherein the sequence of the anti-sense strand is the sequence of the anti-sense strand of AD-25911.

A RNAi agent comprising a sense strand and an anti-sense strand, wherein the sequence of the anti-sense strand is the sequence of the anti-sense strand of AD-26786.

A RNAi agent comprising a sense strand and an anti-sense strand, wherein the sequence of the anti-sense strand is the sequence of the anti-sense strand of AD-19069.

A RNAi agent comprising a sense strand and an anti-sense strand, wherein the sequence of the anti-sense strand is the sequence of the anti-sense strand of AD-26037.

A RNAi agent comprising a sense strand and an anti-sense strand, wherein the sequence of the anti-sense strand is the sequence of the anti-sense strand of AD-26723.

A RNAi agent comprising a sense strand and an anti-sense strand, wherein the sequence of the anti-sense strand is the sequence of the anti-sense strand of AD-19067.

A RNAi agent comprising a sense strand and an anti-sense strand, wherein the sequence of the anti-sense strand is the sequence of the anti-sense strand of AD-25928.

A RNAi agent comprising a sense strand and an anti-sense strand, wherein the sequence of the anti-sense strand is the sequence of the anti-sense strand of AD-26677.

A RNAi agent comprising a sense strand and an anti-sense strand, wherein the sequence of the anti-sense strand is the sequence of the anti-sense strand of AD-19006.

A RNAi agent comprising a sense strand and an anti-sense strand, wherein the sequence of the anti-sense strand is the sequence of the anti-sense strand of AD-19758.

A RNAi agent comprising a sense strand and an anti-sense strand, wherein the sequence of the anti-sense strand is the sequence of the anti-sense strand of AD-26913.

A RNAi agent comprising a sense strand and an anti-sense strand, wherein the sequence of the anti-sense strand is the sequence of the anti-sense strand of AD-25917.

A RNAi agent comprising a sense strand and an anti-sense strand, wherein the sequence of the anti-sense strand is the sequence of the anti-sense strand of AD-26189.

A RNAi agent comprising a sense strand and an anti-sense strand, wherein the sequence of the anti-sense strand is the sequence of the anti-sense strand of AD-26787.

A RNAi agent comprising a sense strand and an anti-sense strand, wherein the sequence of the anti-sense strand is the sequence of the anti-sense strand of AD-26707.

A RNAi agent comprising a sense strand and an anti-sense strand, wherein the sequence of the anti-sense strand is the sequence of the anti-sense strand of AD-26094.

A RNAi agent comprising a sense strand and an anti-sense strand, wherein the sequence of the anti-sense strand is the sequence of the anti-sense strand of AD-26097.

A RNAi agent comprising a sense strand and an anti-sense strand, wherein the sequence of the anti-sense strand is the sequence of the anti-sense strand of AD-26699.

A RNAi agent comprising a sense strand and an anti-sense strand, wherein the sequence of the anti-sense strand is the sequence of the anti-sense strand of AD-26756.

A RNAi agent comprising a sense strand and an anti-sense strand, wherein the sequence of the anti-sense strand is the sequence of the anti-sense strand of AD-26720.

A RNAi agent comprising a sense strand and an anti-sense strand, wherein the sequence of the anti-sense strand is the sequence of the anti-sense strand of AD-25926.

A RNAi agent comprising a sense strand and an anti-sense strand, wherein the sequence of the anti-sense strand is the sequence of the anti-sense strand of AD-26212.

A RNAi agent comprising a sense strand and an anti-sense strand, wherein the sequence of the anti-sense strand is the sequence of the anti-sense strand of AD-26687.

A RNAi agent comprising a sense strand and an anti-sense strand, wherein the sequence of the anti-sense strand is the sequence of the anti-sense strand of AD-26753.

A RNAi agent comprising a sense strand and an anti-sense strand, wherein the sequence of the anti-sense strand is the sequence of the anti-sense strand of AD-18982.

A RNAi agent comprising a sense strand and an anti-sense strand, wherein the sequence of the anti-sense strand is the sequence of the anti-sense strand of AD-18908.

A RNAi agent comprising a sense strand and an anti-sense strand, wherein the sequence of the anti-sense strand is the sequence of the anti-sense strand of AD-18968.

A RNAi agent comprising a sense strand and an anti-sense strand, wherein the sequence of the anti-sense strand is the sequence of the anti-sense strand of AD-25948.

A RNAi agent comprising a sense strand and an anti-sense strand, wherein the sequence of the anti-sense strand is the sequence of the anti-sense strand of AD-26188.

A RNAi agent comprising a sense strand and an anti-sense strand, wherein the sequence of the anti-sense strand is the sequence of the anti-sense strand of AD-26708.

A RNAi agent comprising a sense strand and an anti-sense strand, wherein the sequence of the anti-sense strand is the sequence of the anti-sense strand of AD-25961.

A RNAi agent comprising a sense strand and an anti-sense strand, wherein the sequence of the anti-sense strand is the sequence of the anti-sense strand of AD-26803.

A RNAi agent comprising a sense strand and an anti-sense strand, wherein the sequence of the anti-sense strand is the sequence of the anti-sense strand of AD-19741.

A RNAi agent comprising a sense strand and an anti-sense strand, wherein the sequence of the anti-sense strand is the sequence of the anti-sense strand of AD-26056.

A RNAi agent comprising a sense strand and an anti-sense strand, wherein the sequence of the anti-sense strand is the sequence of the anti-sense strand of AD-25959.

A RNAi agent comprising a sense strand and an anti-sense strand, wherein the sequence of the anti-sense strand is the sequence of the anti-sense strand of AD-26059.

A RNAi agent comprising a sense strand and an anti-sense strand, wherein the sequence of the anti-sense strand is the sequence of the anti-sense strand of AD-26102.

A RNAi agent comprising a sense strand and an anti-sense strand, wherein the sequence of the anti-sense strand is the sequence of the anti-sense strand of AD-26106.

A RNAi agent comprising a sense strand and an anti-sense strand, wherein the sequence of the anti-sense strand is the sequence of the anti-sense strand of AD-26744.

A RNAi agent comprising a sense strand and an anti-sense strand, wherein the sequence of the anti-sense strand is the sequence of the anti-sense strand of AD-26099.

A RNAi agent comprising a sense strand and an anti-sense strand, wherein the sequence of the anti-sense strand is the sequence of the anti-sense strand of AD-26170.

A RNAi agent comprising a sense strand and an anti-sense strand, wherein the sequence of the anti-sense strand is the sequence of the anti-sense strand of AD-19012.

A RNAi agent comprising a sense strand and an anti-sense strand, wherein the sequence of the anti-sense strand is the sequence of the anti-sense strand of AD-26198.

A RNAi agent comprising a sense strand and an anti-sense strand, wherein the sequence of the anti-sense strand is the sequence of the anti-sense strand of AD-26766.

A RNAi agent comprising a sense strand and an anti-sense strand, wherein the sequence of the anti-sense strand is the sequence of the anti-sense strand of AD-18951.

A RNAi agent comprising a sense strand and an anti-sense strand, wherein the sequence of the anti-sense strand is the sequence of the anti-sense strand of AD-18975.

A RNAi agent comprising a sense strand and an anti-sense strand, wherein the sequence of the anti-sense strand is the sequence of the anti-sense strand of AD-26749.

A RNAi agent comprising a sense strand and an anti-sense strand, wherein the sequence of the anti-sense strand is the sequence of the anti-sense strand of AD-18911.

A RNAi agent comprising a sense strand and an anti-sense strand, wherein the sequence of the anti-sense strand is the sequence of the anti-sense strand of AD-26906.

A RNAi agent comprising a sense strand and an anti-sense strand, wherein the sequence of the anti-sense strand is the sequence of the anti-sense strand of AD-19747.

A RNAi agent comprising a sense strand and an anti-sense strand, wherein the sequence of the anti-sense strand is the sequence of the anti-sense strand of AD-18960.

A RNAi agent comprising a sense strand and an anti-sense strand, wherein the sequence of the anti-sense strand is the sequence of the anti-sense strand of AD-25909.

A RNAi agent comprising a sense strand and an anti-sense strand, wherein the sequence of the anti-sense strand is the sequence of the anti-sense strand of AD-26184.

A RNAi agent comprising a sense strand and an anti-sense strand, wherein the sequence of the anti-sense strand is the sequence of the anti-sense strand of AD-26077.

A RNAi agent comprising a sense strand and an anti-sense strand, wherein the sequence of the anti-sense strand is the sequence of the anti-sense strand of AD-26680.

A RNAi agent comprising a sense strand and an anti-sense strand, wherein the sequence of the anti-sense strand is the sequence of the anti-sense strand of AD-26085.

A RNAi agent comprising a sense strand and an anti-sense strand, wherein the sequence of the anti-sense strand is the sequence of the anti-sense strand of AD-18926.

A RNAi agent comprising a sense strand and an anti-sense strand, wherein the sequence of the anti-sense strand is the sequence of the anti-sense strand of AD-18945.

A RNAi agent comprising a sense strand and an anti-sense strand, wherein the sequence of the anti-sense strand is the sequence of the anti-sense strand of AD-26703.

A RNAi agent comprising a sense strand and an anti-sense strand, wherein the sequence of the anti-sense strand is the sequence of the anti-sense strand of AD-26911.

A RNAi agent comprising a sense strand and an anti-sense strand, wherein the sequence of the anti-sense strand is the sequence of the anti-sense strand of AD-26661.

A RNAi agent comprising a sense strand and an anti-sense strand, wherein the sequence of the anti-sense strand is the sequence of the anti-sense strand of AD-18905.

A RNAi agent comprising a sense strand and an anti-sense strand, wherein the sequence of the anti-sense strand is the sequence of the anti-sense strand of AD-26142.

A RNAi agent comprising: a sense strand and an anti-sense strand, wherein the sequence of the anti-sense strand is the sequence of the anti-sense strand of Set1_1245.

A RNAi agent comprising: a sense strand and an anti-sense strand, wherein the sequence of the anti-sense strand is the sequence of the anti-sense strand of Set1_1249.

A RNAi agent comprising: a sense strand and an anti-sense strand, wherein the sequence of the anti-sense strand is the sequence of the anti-sense strand of Set1_1250.

A RNAi agent comprising: a sense strand and an anti-sense strand, wherein the sequence of the anti-sense strand is the sequence of the anti-sense strand of Set1_1450.

A RNAi agent comprising: a sense strand and an anti-sense strand, wherein the sequence of the anti-sense strand is the sequence of the anti-sense strand of Set1_1545.

A RNAi agent comprising: a sense strand and an anti-sense strand, wherein the sequence of the anti-sense strand is the sequence of the anti-sense strand of Set1_1755.

A RNAi agent comprising: a sense strand and an anti-sense strand, wherein the sequence of the anti-sense strand is the sequence of the anti-sense strand of Set1_1814.

A RNAi agent comprising: a sense strand and an anti-sense strand, wherein the sequence of the anti-sense strand is the sequence of the anti-sense strand of Set1_1816.

A RNAi agent comprising: a sense strand and an anti-sense strand, wherein the sequence of the anti-sense strand is the sequence of the anti-sense strand of Set1_1974.

A RNAi agent comprising: a sense strand and an anti-sense strand, wherein the sequence of the anti-sense strand is the sequence of the anti-sense strand of Set1_2202.

A RNAi agent comprising: a sense strand and an anti-sense strand, wherein the sequence of the anti-sense strand is the sequence of the anti-sense strand of Set1_2425.

A RNAi agent comprising: a sense strand and an anti-sense strand, wherein the sequence of the anti-sense strand is the sequence of the anti-sense strand of Set1_254.

A RNAi agent comprising: a sense strand and an anti-sense strand, wherein the sequence of the anti-sense strand is the sequence of the anti-sense strand of Set1_3146.

A RNAi agent comprising: a sense strand and an anti-sense strand, wherein the sequence of the anti-sense strand is the sequence of the anti-sense strand of Set1_3169.

A RNAi agent comprising: a sense strand and an anti-sense strand, wherein the sequence of the anti-sense strand is the sequence of the anti-sense strand of Set1_3196.

A RNAi agent comprising: a sense strand and an anti-sense strand, wherein the sequence of the anti-sense strand is the sequence of the anti-sense strand of Set1_3477.

A RNAi agent comprising: a sense strand and an anti-sense strand, wherein the sequence of the anti-sense strand is the sequence of the anti-sense strand of Set1_703.

A RNAi agent comprising: a sense strand and an anti-sense strand, wherein the sequence of the anti-sense strand is the sequence of the anti-sense strand of Set1_709.

A RNAi agent comprising: a sense strand and an anti-sense strand, wherein the sequence of the anti-sense strand is the sequence of the anti-sense strand of Set1_865.

A RNAi agent comprising: a sense strand and an anti-sense strand, wherein the sequence of the anti-sense strand is the sequence of the anti-sense strand of Set1_889.

A RNAi agent comprising: a sense strand and an anti-sense strand, wherein the sequence of the anti-sense strand is the sequence of the anti-sense strand of Set1_895.

Additional Embodiments Encompassing Specific RNAi Agents to Beta-Catenin

In various embodiments, the present disclosure pertains to a composition comprising one or more of the following:

A RNAi agent comprising a first strand and a second strand, wherein the sequence of the first or second strand is the sequence of the first or second strand of AD-26104, and wherein the first and/or second strand further comprises up to about 20 additional nucleotides.

A RNAi agent comprising a first strand and a second strand, wherein the sequence of the first or second strand is the sequence of the first or second strand of AD-26063, and wherein the first and/or second strand further comprises up to about 20 additional nucleotides.

A RNAi agent comprising a first strand and a second strand, wherein the sequence of the first or second strand is the sequence of the first or second strand of AD-26082, and wherein the first and/or second strand further comprises up to about 20 additional nucleotides.

A RNAi agent comprising a first strand and a second strand, wherein the sequence of the first or second strand is the sequence of the first or second strand of AD-26034, and wherein the first and/or second strand further comprises up to about 20 additional nucleotides.

A RNAi agent comprising a first strand and a second strand, wherein the sequence of the first or second strand is the sequence of the first or second strand of AD-26091, and wherein the first and/or second strand further comprises up to about 20 additional nucleotides.

A RNAi agent comprising a first strand and a second strand, wherein the sequence of the first or second strand is the sequence of the first or second strand of AD-26047, and wherein the first and/or second strand further comprises up to about 20 additional nucleotides.

A RNAi agent comprising a first strand and a second strand, wherein the sequence of the first or second strand is the sequence of the first or second strand of AD-26651, and wherein the first and/or second strand further comprises up to about 20 additional nucleotides.

A RNAi agent comprising a first strand and a second strand, wherein the sequence of the first or second strand is the sequence of the first or second strand of AD-26696, and wherein the first and/or second strand further comprises up to about 20 additional nucleotides.

A RNAi agent comprising a first strand and a second strand, wherein the sequence of the first or second strand is the sequence of the first or second strand of AD-26109, and wherein the first and/or second strand further comprises up to about 20 additional nucleotides.

A RNAi agent comprising a first strand and a second strand, wherein the sequence of the first or second strand is the sequence of the first or second strand of AD-25941, and wherein the first and/or second strand further comprises up to about 20 additional nucleotides.

A RNAi agent comprising a first strand and a second strand, wherein the sequence of the first or second strand is the sequence of the first or second strand of AD-26028, and wherein the first and/or second strand further comprises up to about 20 additional nucleotides.

A RNAi agent comprising a first strand and a second strand, wherein the sequence of the first or second strand is the sequence of the first or second strand of AD-26652, and wherein the first and/or second strand further comprises up to about 20 additional nucleotides.

A RNAi agent comprising a first strand and a second strand, wherein the sequence of the first or second strand is the sequence of the first or second strand of AD-26742, and wherein the first and/or second strand further comprises up to about 20 additional nucleotides.

A RNAi agent comprising a first strand and a second strand, wherein the sequence of the first or second strand is the sequence of the first or second strand of AD-26921, and wherein the first and/or second strand further comprises up to about 20 additional nucleotides.

A RNAi agent comprising a first strand and a second strand, wherein the sequence of the first or second strand is the sequence of the first or second strand of AD-18893, and wherein the first and/or second strand further comprises up to about 20 additional nucleotides.

A RNAi agent comprising a first strand and a second strand, wherein the sequence of the first or second strand is the sequence of the first or second strand of AD-18983, and wherein the first and/or second strand further comprises up to about 20 additional nucleotides.

A RNAi agent comprising a first strand and a second strand, wherein the sequence of the first or second strand is the sequence of the first or second strand of AD-25950, and wherein the first and/or second strand further comprises up to about 20 additional nucleotides.

A RNAi agent comprising a first strand and a second strand, wherein the sequence of the first or second strand is the sequence of the first or second strand of AD-25951, and wherein the first and/or second strand further comprises up to about 20 additional nucleotides.

A RNAi agent comprising a first strand and a second strand, wherein the sequence of the first or second strand is the sequence of the first or second strand of AD-26042, and wherein the first and/or second strand further comprises up to about 20 additional nucleotides.

A RNAi agent comprising a first strand and a second strand, wherein the sequence of the first or second strand is the sequence of the first or second strand of AD-26043, and wherein the first and/or second strand further comprises up to about 20 additional nucleotides.

A RNAi agent comprising a first strand and a second strand, wherein the sequence of the first or second strand is the sequence of the first or second strand of AD-26673, and wherein the first and/or second strand further comprises up to about 20 additional nucleotides.

A RNAi agent comprising a first strand and a second strand, wherein the sequence of the first or second strand is the sequence of the first or second strand of AD-26704, and wherein the first and/or second strand further comprises up to about 20 additional nucleotides.

A RNAi agent comprising a first strand and a second strand, wherein the sequence of the first or second strand is the sequence of the first or second strand of AD-26068, and wherein the first and/or second strand further comprises up to about 20 additional nucleotides.

A RNAi agent comprising a first strand and a second strand, wherein the sequence of the first or second strand is the sequence of the first or second strand of AD-26183, and wherein the first and/or second strand further comprises up to about 20 additional nucleotides.

A RNAi agent comprising a first strand and a second strand, wherein the sequence of the first or second strand is the sequence of the first or second strand of AD-26700, and wherein the first and/or second strand further comprises up to about 20 additional nucleotides.

A RNAi agent comprising a first strand and a second strand, wherein the sequence of the first or second strand is the sequence of the first or second strand of AD-26701, and wherein the first and/or second strand further comprises up to about 20 additional nucleotides.

A RNAi agent comprising a first strand and a second strand, wherein the sequence of the first or second strand is the sequence of the first or second strand of AD-25942, and wherein the first and/or second strand further comprises up to about 20 additional nucleotides.

A RNAi agent comprising a first strand and a second strand, wherein the sequence of the first or second strand is the sequence of the first or second strand of AD-26076, and wherein the first and/or second strand further comprises up to about 20 additional nucleotides.

A RNAi agent comprising a first strand and a second strand, wherein the sequence of the first or second strand is the sequence of the first or second strand of AD-26031, and wherein the first and/or second strand further comprises up to about 20 additional nucleotides.

A RNAi agent comprising a first strand and a second strand, wherein the sequence of the first or second strand is the sequence of the first or second strand of AD-26210, and wherein the first and/or second strand further comprises up to about 20 additional nucleotides.

A RNAi agent comprising a first strand and a second strand, wherein the sequence of the first or second strand is the sequence of the first or second strand of AD-26664, and wherein the first and/or second strand further comprises up to about 20 additional nucleotides.

A RNAi agent comprising a first strand and a second strand, wherein the sequence of the first or second strand is the sequence of the first or second strand of AD-26691, and wherein the first and/or second strand further comprises up to about 20 additional nucleotides.

A RNAi agent comprising a first strand and a second strand, wherein the sequence of the first or second strand is the sequence of the first or second strand of AD-26740, and wherein the first and/or second strand further comprises up to about 20 additional nucleotides.

A RNAi agent comprising a first strand and a second strand, wherein the sequence of the first or second strand is the sequence of the first or second strand of AD-19765, and wherein the first and/or second strand further comprises up to about 20 additional nucleotides.

A RNAi agent comprising a first strand and a second strand, wherein the sequence of the first or second strand is the sequence of the first or second strand of AD-26158, and wherein the first and/or second strand further comprises up to about 20 additional nucleotides.

A RNAi agent comprising a first strand and a second strand, wherein the sequence of the first or second strand is the sequence of the first or second strand of AD-26180, and wherein the first and/or second strand further comprises up to about 20 additional nucleotides.

A RNAi agent comprising a first strand and a second strand, wherein the sequence of the first or second strand is the sequence of the first or second strand of AD-26078, and wherein the first and/or second strand further comprises up to about 20 additional nucleotides.

A RNAi agent comprising a first strand and a second strand, wherein the sequence of the first or second strand is the sequence of the first or second strand of AD-25894, and wherein the first and/or second strand further comprises up to about 20 additional nucleotides.

A RNAi agent comprising a first strand and a second strand, wherein the sequence of the first or second strand is the sequence of the first or second strand of AD-25964, and wherein the first and/or second strand further comprises up to about 20 additional nucleotides.

A RNAi agent comprising a first strand and a second strand, wherein the sequence of the first or second strand is the sequence of the first or second strand of AD-26156, and wherein the first and/or second strand further comprises up to about 20 additional nucleotides.

A RNAi agent comprising a first strand and a second strand, wherein the sequence of the first or second strand is the sequence of the first or second strand of AD-26670, and wherein the first and/or second strand further comprises up to about 20 additional nucleotides.

A RNAi agent comprising a first strand and a second strand, wherein the sequence of the first or second strand is the sequence of the first or second strand of AD-26743, and wherein the first and/or second strand further comprises up to about 20 additional nucleotides.

A RNAi agent comprising a first strand and a second strand, wherein the sequence of the first or second strand is the sequence of the first or second strand of AD-25890, and wherein the first and/or second strand further comprises up to about 20 additional nucleotides.

A RNAi agent comprising a first strand and a second strand, wherein the sequence of the first or second strand is the sequence of the first or second strand of AD-26044, and wherein the first and/or second strand further comprises up to about 20 additional nucleotides.

A RNAi agent comprising a first strand and a second strand, wherein the sequence of the first or second strand is the sequence of the first or second strand of AD-26685, and wherein the first and/or second strand further comprises up to about 20 additional nucleotides.

A RNAi agent comprising a first strand and a second strand, wherein the sequence of the first or second strand is the sequence of the first or second strand of AD-26731, and wherein the first and/or second strand further comprises up to about 20 additional nucleotides.

A RNAi agent comprising a first strand and a second strand, wherein the sequence of the first or second strand is the sequence of the first or second strand of AD-26800, and wherein the first and/or second strand further comprises up to about 20 additional nucleotides.

A RNAi agent comprising a first strand and a second strand, wherein the sequence of the first or second strand is the sequence of the first or second strand of AD-26066, and wherein the first and/or second strand further comprises up to about 20 additional nucleotides.

A RNAi agent comprising a first strand and a second strand, wherein the sequence of the first or second strand is the sequence of the first or second strand of AD-26682, and wherein the first and/or second strand further comprises up to about 20 additional nucleotides.

A RNAi agent comprising a first strand and a second strand, wherein the sequence of the first or second strand is the sequence of the first or second strand of AD-26684, and wherein the first and/or second strand further comprises up to about 20 additional nucleotides.

A RNAi agent comprising a first strand and a second strand, wherein the sequence of the first or second strand is the sequence of the first or second strand of AD-26757, and wherein the first and/or second strand further comprises up to about 20 additional nucleotides.

A RNAi agent comprising a first strand and a second strand, wherein the sequence of the first or second strand is the sequence of the first or second strand of AD-26788, and wherein the first and/or second strand further comprises up to about 20 additional nucleotides.

A RNAi agent comprising a first strand and a second strand, wherein the sequence of the first or second strand is the sequence of the first or second strand of AD-18963, and wherein the first and/or second strand further comprises up to about 20 additional nucleotides.

A RNAi agent comprising a first strand and a second strand, wherein the sequence of the first or second strand is the sequence of the first or second strand of AD-19076, and wherein the first and/or second strand further comprises up to about 20 additional nucleotides.

A RNAi agent comprising a first strand and a second strand, wherein the sequence of the first or second strand is the sequence of the first or second strand of AD-25943, and wherein the first and/or second strand further comprises up to about 20 additional nucleotides.

A RNAi agent comprising a first strand and a second strand, wherein the sequence of the first or second strand is the sequence of the first or second strand of AD-26052, and wherein the first and/or second strand further comprises up to about 20 additional nucleotides.

A RNAi agent comprising a first strand and a second strand, wherein the sequence of the first or second strand is the sequence of the first or second strand of AD-26665, and wherein the first and/or second strand further comprises up to about 20 additional nucleotides.

A RNAi agent comprising a first strand and a second strand, wherein the sequence of the first or second strand is the sequence of the first or second strand of AD-26746, and wherein the first and/or second strand further comprises up to about 20 additional nucleotides.

A RNAi agent comprising a first strand and a second strand, wherein the sequence of the first or second strand is the sequence of the first or second strand of AD-18974, and wherein the first and/or second strand further comprises up to about 20 additional nucleotides.

A RNAi agent comprising a first strand and a second strand, wherein the sequence of the first or second strand is the sequence of the first or second strand of AD-25938, and wherein the first and/or second strand further comprises up to about 20 additional nucleotides.

A RNAi agent comprising a first strand and a second strand, wherein the sequence of the first or second strand is the sequence of the first or second strand of AD-25944, and wherein the first and/or second strand further comprises up to about 20 additional nucleotides.

A RNAi agent comprising a first strand and a second strand, wherein the sequence of the first or second strand is the sequence of the first or second strand of AD-26178, and wherein the first and/or second strand further comprises up to about 20 additional nucleotides.

A RNAi agent comprising a first strand and a second strand, wherein the sequence of the first or second strand is the sequence of the first or second strand of AD-26669, and wherein the first and/or second strand further comprises up to about 20 additional nucleotides.

A RNAi agent comprising a first strand and a second strand, wherein the sequence of the first or second strand is the sequence of the first or second strand of AD-26730, and wherein the first and/or second strand further comprises up to about 20 additional nucleotides.

A RNAi agent comprising a first strand and a second strand, wherein the sequence of the first or second strand is the sequence of the first or second strand of AD-26825, and wherein the first and/or second strand further comprises up to about 20 additional nucleotides.

A RNAi agent comprising a first strand and a second strand, wherein the sequence of the first or second strand is the sequence of the first or second strand of AD-25956, and wherein the first and/or second strand further comprises up to about 20 additional nucleotides.

A RNAi agent comprising a first strand and a second strand, wherein the sequence of the first or second strand is the sequence of the first or second strand of AD-26822, and wherein the first and/or second strand further comprises up to about 20 additional nucleotides.

A RNAi agent comprising a first strand and a second strand, wherein the sequence of the first or second strand is the sequence of the first or second strand of AD-26108, and wherein the first and/or second strand further comprises up to about 20 additional nucleotides.

A RNAi agent comprising a first strand and a second strand, wherein the sequence of the first or second strand is the sequence of the first or second strand of AD-26752, and wherein the first and/or second strand further comprises up to about 20 additional nucleotides.

A RNAi agent comprising a first strand and a second strand, wherein the sequence of the first or second strand is the sequence of the first or second strand of AD-26779, and wherein the first and/or second strand further comprises up to about 20 additional nucleotides.

A RNAi agent comprising a first strand and a second strand, wherein the sequence of the first or second strand is the sequence of the first or second strand of AD-25891, and wherein the first and/or second strand further comprises up to about 20 additional nucleotides.

A RNAi agent comprising a first strand and a second strand, wherein the sequence of the first or second strand is the sequence of the first or second strand of AD-26101, and wherein the first and/or second strand further comprises up to about 20 additional nucleotides.

A RNAi agent comprising a first strand and a second strand, wherein the sequence of the first or second strand is the sequence of the first or second strand of AD-26181, and wherein the first and/or second strand further comprises up to about 20 additional nucleotides.

A RNAi agent comprising a first strand and a second strand, wherein the sequence of the first or second strand is the sequence of the first or second strand of AD-26218, and wherein the first and/or second strand further comprises up to about 20 additional nucleotides.

A RNAi agent comprising a first strand and a second strand, wherein the sequence of the first or second strand is the sequence of the first or second strand of AD-26660, and wherein the first and/or second strand further comprises up to about 20 additional nucleotides.

A RNAi agent comprising a first strand and a second strand, wherein the sequence of the first or second strand is the sequence of the first or second strand of AD-18966, and wherein the first and/or second strand further comprises up to about 20 additional nucleotides.

A RNAi agent comprising a first strand and a second strand, wherein the sequence of the first or second strand is the sequence of the first or second strand of AD-19074, and wherein the first and/or second strand further comprises up to about 20 additional nucleotides.

A RNAi agent comprising a first strand and a second strand, wherein the sequence of the first or second strand is the sequence of the first or second strand of AD-26179, and wherein the first and/or second strand further comprises up to about 20 additional nucleotides.

A RNAi agent comprising a first strand and a second strand, wherein the sequence of the first or second strand is the sequence of the first or second strand of AD-26722, and wherein the first and/or second strand further comprises up to about 20 additional nucleotides.

A RNAi agent comprising a first strand and a second strand, wherein the sequence of the first or second strand is the sequence of the first or second strand of AD-26768, and wherein the first and/or second strand further comprises up to about 20 additional nucleotides.

A RNAi agent comprising a first strand and a second strand, wherein the sequence of the first or second strand is the sequence of the first or second strand of AD-26920, and wherein the first and/or second strand further comprises up to about 20 additional nucleotides.

A RNAi agent comprising a first strand and a second strand, wherein the sequence of the first or second strand is the sequence of the first or second strand of AD-26020, and wherein the first and/or second strand further comprises up to about 20 additional nucleotides.

A RNAi agent comprising a first strand and a second strand, wherein the sequence of the first or second strand is the sequence of the first or second strand of AD-26713, and wherein the first and/or second strand further comprises up to about 20 additional nucleotides.

A RNAi agent comprising a first strand and a second strand, wherein the sequence of the first or second strand is the sequence of the first or second strand of AD-26727, and wherein the first and/or second strand further comprises up to about 20 additional nucleotides.

A RNAi agent comprising a first strand and a second strand, wherein the sequence of the first or second strand is the sequence of the first or second strand of AD-26808, and wherein the first and/or second strand further comprises up to about 20 additional nucleotides.

A RNAi agent comprising a first strand and a second strand, wherein the sequence of the first or second strand is the sequence of the first or second strand of AD-25958, and wherein the first and/or second strand further comprises up to about 20 additional nucleotides.

A RNAi agent comprising a first strand and a second strand, wherein the sequence of the first or second strand is the sequence of the first or second strand of AD-26105, and wherein the first and/or second strand further comprises up to about 20 additional nucleotides.

A RNAi agent comprising a first strand and a second strand, wherein the sequence of the first or second strand is the sequence of the first or second strand of AD-26674, and wherein the first and/or second strand further comprises up to about 20 additional nucleotides.

A RNAi agent comprising a first strand and a second strand, wherein the sequence of the first or second strand is the sequence of the first or second strand of AD-26781, and wherein the first and/or second strand further comprises up to about 20 additional nucleotides.

A RNAi agent comprising a first strand and a second strand, wherein the sequence of the first or second strand is the sequence of the first or second strand of AD-26801, and wherein the first and/or second strand further comprises up to about 20 additional nucleotides.

A RNAi agent comprising a first strand and a second strand, wherein the sequence of the first or second strand is the sequence of the first or second strand of AD-26813, and wherein the first and/or second strand further comprises up to about 20 additional nucleotides.

A RNAi agent comprising a first strand and a second strand, wherein the sequence of the first or second strand is the sequence of the first or second strand of AD-26816, and wherein the first and/or second strand further comprises up to about 20 additional nucleotides.

A RNAi agent comprising a first strand and a second strand, wherein the sequence of the first or second strand is the sequence of the first or second strand of AD-25945, and wherein the first and/or second strand further comprises up to about 20 additional nucleotides.

A RNAi agent comprising a first strand and a second strand, wherein the sequence of the first or second strand is the sequence of the first or second strand of AD-26203, and wherein the first and/or second strand further comprises up to about 20 additional nucleotides.

A RNAi agent comprising a first strand and a second strand, wherein the sequence of the first or second strand is the sequence of the first or second strand of AD-26021, and wherein the first and/or second strand further comprises up to about 20 additional nucleotides.

A RNAi agent comprising a first strand and a second strand, wherein the sequence of the first or second strand is the sequence of the first or second strand of AD-26040, and wherein the first and/or second strand further comprises up to about 20 additional nucleotides.

A RNAi agent comprising a first strand and a second strand, wherein the sequence of the first or second strand is the sequence of the first or second strand of AD-26069, and wherein the first and/or second strand further comprises up to about 20 additional nucleotides.

A RNAi agent comprising a first strand and a second strand, wherein the sequence of the first or second strand is the sequence of the first or second strand of AD-26134, and wherein the first and/or second strand further comprises up to about 20 additional nucleotides.

A RNAi agent comprising a first strand and a second strand, wherein the sequence of the first or second strand is the sequence of the first or second strand of AD-26702, and wherein the first and/or second strand further comprises up to about 20 additional nucleotides.

A RNAi agent comprising a first strand and a second strand, wherein the sequence of the first or second strand is the sequence of the first or second strand of AD-18933, and wherein the first and/or second strand further comprises up to about 20 additional nucleotides.

A RNAi agent comprising a first strand and a second strand, wherein the sequence of the first or second strand is the sequence of the first or second strand of AD-26690, and wherein the first and/or second strand further comprises up to about 20 additional nucleotides.

A RNAi agent comprising a first strand and a second strand, wherein the sequence of the first or second strand is the sequence of the first or second strand of AD-26698, and wherein the first and/or second strand further comprises up to about 20 additional nucleotides.

A RNAi agent comprising a first strand and a second strand, wherein the sequence of the first or second strand is the sequence of the first or second strand of AD-25910, and wherein the first and/or second strand further comprises up to about 20 additional nucleotides.

A RNAi agent comprising a first strand and a second strand, wherein the sequence of the first or second strand is the sequence of the first or second strand of AD-26747, and wherein the first and/or second strand further comprises up to about 20 additional nucleotides.

A RNAi agent comprising a first strand and a second strand, wherein the sequence of the first or second strand is the sequence of the first or second strand of AD-26810, and wherein the first and/or second strand further comprises up to about 20 additional nucleotides.

A RNAi agent comprising a first strand and a second strand, wherein the sequence of the first or second strand is the sequence of the first or second strand of AD-26083, and wherein the first and/or second strand further comprises up to about 20 additional nucleotides.

A RNAi agent comprising a first strand and a second strand, wherein the sequence of the first or second strand is the sequence of the first or second strand of AD-26061, and wherein the first and/or second strand further comprises up to about 20 additional nucleotides.

A RNAi agent comprising a first strand and a second strand, wherein the sequence of the first or second strand is the sequence of the first or second strand of AD-26904, and wherein the first and/or second strand further comprises up to about 20 additional nucleotides.

A RNAi agent comprising a first strand and a second strand, wherein the sequence of the first or second strand is the sequence of the first or second strand of AD-18903, and wherein the first and/or second strand further comprises up to about 20 additional nucleotides.

A RNAi agent comprising a first strand and a second strand, wherein the sequence of the first or second strand is the sequence of the first or second strand of AD-18980, and wherein the first and/or second strand further comprises up to about 20 additional nucleotides.

A RNAi agent comprising a first strand and a second strand, wherein the sequence of the first or second strand is the sequence of the first or second strand of AD-26202, and wherein the first and/or second strand further comprises up to about 20 additional nucleotides.

A RNAi agent comprising a first strand and a second strand, wherein the sequence of the first or second strand is the sequence of the first or second strand of AD-26679, and wherein the first and/or second strand further comprises up to about 20 additional nucleotides.

A RNAi agent comprising a first strand and a second strand, wherein the sequence of the first or second strand is the sequence of the first or second strand of AD-26719, and wherein the first and/or second strand further comprises up to about 20 additional nucleotides.

A RNAi agent comprising a first strand and a second strand, wherein the sequence of the first or second strand is the sequence of the first or second strand of AD-26758, and wherein the first and/or second strand further comprises up to about 20 additional nucleotides.

A RNAi agent comprising a first strand and a second strand, wherein the sequence of the first or second strand is the sequence of the first or second strand of AD-26783, and wherein the first and/or second strand further comprises up to about 20 additional nucleotides.

A RNAi agent comprising a first strand and a second strand, wherein the sequence of the first or second strand is the sequence of the first or second strand of AD-26902, and wherein the first and/or second strand further comprises up to about 20 additional nucleotides.

A RNAi agent comprising a first strand and a second strand, wherein the sequence of the first or second strand is the sequence of the first or second strand of AD-18892, and wherein the first and/or second strand further comprises up to about 20 additional nucleotides.

A RNAi agent comprising a first strand and a second strand, wherein the sequence of the first or second strand is the sequence of the first or second strand of AD-18897, and wherein the first and/or second strand further comprises up to about 20 additional nucleotides.

A RNAi agent comprising a first strand and a second strand, wherein the sequence of the first or second strand is the sequence of the first or second strand of AD-25902, and wherein the first and/or second strand further comprises up to about 20 additional nucleotides.

A RNAi agent comprising a first strand and a second strand, wherein the sequence of the first or second strand is the sequence of the first or second strand of AD-26705, and wherein the first and/or second strand further comprises up to about 20 additional nucleotides.

A RNAi agent comprising a first strand and a second strand, wherein the sequence of the first or second strand is the sequence of the first or second strand of AD-26782, and wherein the first and/or second strand further comprises up to about 20 additional nucleotides.

A RNAi agent comprising a first strand and a second strand, wherein the sequence of the first or second strand is the sequence of the first or second strand of AD-19082, and wherein the first and/or second strand further comprises up to about 20 additional nucleotides.

A RNAi agent comprising a first strand and a second strand, wherein the sequence of the first or second strand is the sequence of the first or second strand of AD-26176, and wherein the first and/or second strand further comprises up to about 20 additional nucleotides.

A RNAi agent comprising a first strand and a second strand, wherein the sequence of the first or second strand is the sequence of the first or second strand of AD-26196, and wherein the first and/or second strand further comprises up to about 20 additional nucleotides.

A RNAi agent comprising a first strand and a second strand, wherein the sequence of the first or second strand is the sequence of the first or second strand of AD-26199, and wherein the first and/or second strand further comprises up to about 20 additional nucleotides.

A RNAi agent comprising a first strand and a second strand, wherein the sequence of the first or second strand is the sequence of the first or second strand of AD-26678, and wherein the first and/or second strand further comprises up to about 20 additional nucleotides.

A RNAi agent comprising a first strand and a second strand, wherein the sequence of the first or second strand is the sequence of the first or second strand of AD-26683, and wherein the first and/or second strand further comprises up to about 20 additional nucleotides.

A RNAi agent comprising a first strand and a second strand, wherein the sequence of the first or second strand is the sequence of the first or second strand of AD-26729, and wherein the first and/or second strand further comprises up to about 20 additional nucleotides.

A RNAi agent comprising a first strand and a second strand, wherein the sequence of the first or second strand is the sequence of the first or second strand of AD-26804, and wherein the first and/or second strand further comprises up to about 20 additional nucleotides.

A RNAi agent comprising a first strand and a second strand, wherein the sequence of the first or second strand is the sequence of the first or second strand of AD-26900, and wherein the first and/or second strand further comprises up to about 20 additional nucleotides.

A RNAi agent comprising a first strand and a second strand, wherein the sequence of the first or second strand is the sequence of the first or second strand of AD-25914, and wherein the first and/or second strand further comprises up to about 20 additional nucleotides.

A RNAi agent comprising a first strand and a second strand, wherein the sequence of the first or second strand is the sequence of the first or second strand of AD-26060, and wherein the first and/or second strand further comprises up to about 20 additional nucleotides.

A RNAi agent comprising a first strand and a second strand, wherein the sequence of the first or second strand is the sequence of the first or second strand of AD-26763, and wherein the first and/or second strand further comprises up to about 20 additional nucleotides.

A RNAi agent comprising a first strand and a second strand, wherein the sequence of the first or second strand is the sequence of the first or second strand of AD-18902, and wherein the first and/or second strand further comprises up to about 20 additional nucleotides.

A RNAi agent comprising a first strand and a second strand, wherein the sequence of the first or second strand is the sequence of the first or second strand of AD-18914, and wherein the first and/or second strand further comprises up to about 20 additional nucleotides.

A RNAi agent comprising a first strand and a second strand, wherein the sequence of the first or second strand is the sequence of the first or second strand of AD-26100, and wherein the first and/or second strand further comprises up to about 20 additional nucleotides.

A RNAi agent comprising a first strand and a second strand, wherein the sequence of the first or second strand is the sequence of the first or second strand of AD-26128, and wherein the first and/or second strand further comprises up to about 20 additional nucleotides.

A RNAi agent comprising a first strand and a second strand, wherein the sequence of the first or second strand is the sequence of the first or second strand of AD-26193, and wherein the first and/or second strand further comprises up to about 20 additional nucleotides.

A RNAi agent comprising a first strand and a second strand, wherein the sequence of the first or second strand is the sequence of the first or second strand of AD-26765, and wherein the first and/or second strand further comprises up to about 20 additional nucleotides.

A RNAi agent comprising a first strand and a second strand, wherein the sequence of the first or second strand is the sequence of the first or second strand of AD-25960, and wherein the first and/or second strand further comprises up to about 20 additional nucleotides.

A RNAi agent comprising a first strand and a second strand, wherein the sequence of the first or second strand is the sequence of the first or second strand of AD-26018, and wherein the first and/or second strand further comprises up to about 20 additional nucleotides.

A RNAi agent comprising a first strand and a second strand, wherein the sequence of the first or second strand is the sequence of the first or second strand of AD-25893, and wherein the first and/or second strand further comprises up to about 20 additional nucleotides.

A RNAi agent comprising a first strand and a second strand, wherein the sequence of the first or second strand is the sequence of the first or second strand of AD-26823, and wherein the first and/or second strand further comprises up to about 20 additional nucleotides.

A RNAi agent comprising a first strand and a second strand, wherein the sequence of the first or second strand is the sequence of the first or second strand of AD-25940, and wherein the first and/or second strand further comprises up to about 20 additional nucleotides.

A RNAi agent comprising a first strand and a second strand, wherein the sequence of the first or second strand is the sequence of the first or second strand of AD-26190, and wherein the first and/or second strand further comprises up to about 20 additional nucleotides.

A RNAi agent comprising a first strand and a second strand, wherein the sequence of the first or second strand is the sequence of the first or second strand of AD-26675, and wherein the first and/or second strand further comprises up to about 20 additional nucleotides.

A RNAi agent comprising a first strand and a second strand, wherein the sequence of the first or second strand is the sequence of the first or second strand of AD-26797, and wherein the first and/or second strand further comprises up to about 20 additional nucleotides.

A RNAi agent comprising a first strand and a second strand, wherein the sequence of the first or second strand is the sequence of the first or second strand of AD-26916, and wherein the first and/or second strand further comprises up to about 20 additional nucleotides.

A RNAi agent comprising a first strand and a second strand, wherein the sequence of the first or second strand is the sequence of the first or second strand of AD-26755, and wherein the first and/or second strand further comprises up to about 20 additional nucleotides.

A RNAi agent comprising a first strand and a second strand, wherein the sequence of the first or second strand is the sequence of the first or second strand of AD-26901, and wherein the first and/or second strand further comprises up to about 20 additional nucleotides.

A RNAi agent comprising a first strand and a second strand, wherein the sequence of the first or second strand is the sequence of the first or second strand of AD-19004, and wherein the first and/or second strand further comprises up to about 20 additional nucleotides.

A RNAi agent comprising a first strand and a second strand, wherein the sequence of the first or second strand is the sequence of the first or second strand of AD-19009, and wherein the first and/or second strand further comprises up to about 20 additional nucleotides.

A RNAi agent comprising a first strand and a second strand, wherein the sequence of the first or second strand is the sequence of the first or second strand of AD-26148, and wherein the first and/or second strand further comprises up to about 20 additional nucleotides.

A RNAi agent comprising a first strand and a second strand, wherein the sequence of the first or second strand is the sequence of the first or second strand of AD-26186, and wherein the first and/or second strand further comprises up to about 20 additional nucleotides.

A RNAi agent comprising a first strand and a second strand, wherein the sequence of the first or second strand is the sequence of the first or second strand of AD-26737, and wherein the first and/or second strand further comprises up to about 20 additional nucleotides.

A RNAi agent comprising a first strand and a second strand, wherein the sequence of the first or second strand is the sequence of the first or second strand of AD-25955, and wherein the first and/or second strand further comprises up to about 20 additional nucleotides.

A RNAi agent comprising a first strand and a second strand, wherein the sequence of the first or second strand is the sequence of the first or second strand of AD-26029, and wherein the first and/or second strand further comprises up to about 20 additional nucleotides.

A RNAi agent comprising a first strand and a second strand, wherein the sequence of the first or second strand is the sequence of the first or second strand of AD-26131, and wherein the first and/or second strand further comprises up to about 20 additional nucleotides.

A RNAi agent comprising a first strand and a second strand, wherein the sequence of the first or second strand is the sequence of the first or second strand of AD-18894, and wherein the first and/or second strand further comprises up to about 20 additional nucleotides.

A RNAi agent comprising a first strand and a second strand, wherein the sequence of the first or second strand is the sequence of the first or second strand of AD-18939, and wherein the first and/or second strand further comprises up to about 20 additional nucleotides.

A RNAi agent comprising a first strand and a second strand, wherein the sequence of the first or second strand is the sequence of the first or second strand of AD-26654, and wherein the first and/or second strand further comprises up to about 20 additional nucleotides.

A RNAi agent comprising a first strand and a second strand, wherein the sequence of the first or second strand is the sequence of the first or second strand of AD-18929, and wherein the first and/or second strand further comprises up to about 20 additional nucleotides.

A RNAi agent comprising a first strand and a second strand, wherein the sequence of the first or second strand is the sequence of the first or second strand of AD-26135, and wherein the first and/or second strand further comprises up to about 20 additional nucleotides.

A RNAi agent comprising a first strand and a second strand, wherein the sequence of the first or second strand is the sequence of the first or second strand of AD-26774, and wherein the first and/or second strand further comprises up to about 20 additional nucleotides.

A RNAi agent comprising a first strand and a second strand, wherein the sequence of the first or second strand is the sequence of the first or second strand of AD-26780, and wherein the first and/or second strand further comprises up to about 20 additional nucleotides.

A RNAi agent comprising a first strand and a second strand, wherein the sequence of the first or second strand is the sequence of the first or second strand of AD-26819, and wherein the first and/or second strand further comprises up to about 20 additional nucleotides.

A RNAi agent comprising a first strand and a second strand, wherein the sequence of the first or second strand is the sequence of the first or second strand of AD-26918, and wherein the first and/or second strand further comprises up to about 20 additional nucleotides.

A RNAi agent comprising a first strand and a second strand, wherein the sequence of the first or second strand is the sequence of the first or second strand of AD-19050, and wherein the first and/or second strand further comprises up to about 20 additional nucleotides.

A RNAi agent comprising a first strand and a second strand, wherein the sequence of the first or second strand is the sequence of the first or second strand of AD-18994, and wherein the first and/or second strand further comprises up to about 20 additional nucleotides.

A RNAi agent comprising a first strand and a second strand, wherein the sequence of the first or second strand is the sequence of the first or second strand of AD-26769, and wherein the first and/or second strand further comprises up to about 20 additional nucleotides.

A RNAi agent comprising a first strand and a second strand, wherein the sequence of the first or second strand is the sequence of the first or second strand of AD-26666, and wherein the first and/or second strand further comprises up to about 20 additional nucleotides.

A RNAi agent comprising a first strand and a second strand, wherein the sequence of the first or second strand is the sequence of the first or second strand of AD-26784, and wherein the first and/or second strand further comprises up to about 20 additional nucleotides.

A RNAi agent comprising a first strand and a second strand, wherein the sequence of the first or second strand is the sequence of the first or second strand of AD-18969, and wherein the first and/or second strand further comprises up to about 20 additional nucleotides.

A RNAi agent comprising a first strand and a second strand, wherein the sequence of the first or second strand is the sequence of the first or second strand of AD-18986, and wherein the first and/or second strand further comprises up to about 20 additional nucleotides.

A RNAi agent comprising a first strand and a second strand, wherein the sequence of the first or second strand is the sequence of the first or second strand of AD-25929, and wherein the first and/or second strand further comprises up to about 20 additional nucleotides.

A RNAi agent comprising a first strand and a second strand, wherein the sequence of the first or second strand is the sequence of the first or second strand of AD-25932, and wherein the first and/or second strand further comprises up to about 20 additional nucleotides.

A RNAi agent comprising a first strand and a second strand, wherein the sequence of the first or second strand is the sequence of the first or second strand of AD-26095, and wherein the first and/or second strand further comprises up to about 20 additional nucleotides.

A RNAi agent comprising a first strand and a second strand, wherein the sequence of the first or second strand is the sequence of the first or second strand of AD-26908, and wherein the first and/or second strand further comprises up to about 20 additional nucleotides.

A RNAi agent comprising a first strand and a second strand, wherein the sequence of the first or second strand is the sequence of the first or second strand of AD-26071, and wherein the first and/or second strand further comprises up to about 20 additional nucleotides.

A RNAi agent comprising a first strand and a second strand, wherein the sequence of the first or second strand is the sequence of the first or second strand of AD-26912, and wherein the first and/or second strand further comprises up to about 20 additional nucleotides.

A RNAi agent comprising a first strand and a second strand, wherein the sequence of the first or second strand is the sequence of the first or second strand of AD-19054, and wherein the first and/or second strand further comprises up to about 20 additional nucleotides.

A RNAi agent comprising a first strand and a second strand, wherein the sequence of the first or second strand is the sequence of the first or second strand of AD-25918, and wherein the first and/or second strand further comprises up to about 20 additional nucleotides.

A RNAi agent comprising a first strand and a second strand, wherein the sequence of the first or second strand is the sequence of the first or second strand of AD-26903, and wherein the first and/or second strand further comprises up to about 20 additional nucleotides.

A RNAi agent comprising a first strand and a second strand, wherein the sequence of the first or second strand is the sequence of the first or second strand of AD-25931, and wherein the first and/or second strand further comprises up to about 20 additional nucleotides.

A RNAi agent comprising a first strand and a second strand, wherein the sequence of the first or second strand is the sequence of the first or second strand of AD-26146, and wherein the first and/or second strand further comprises up to about 20 additional nucleotides.

A RNAi agent comprising a first strand and a second strand, wherein the sequence of the first or second strand is the sequence of the first or second strand of AD-26200, and wherein the first and/or second strand further comprises up to about 20 additional nucleotides.

A RNAi agent comprising a first strand and a second strand, wherein the sequence of the first or second strand is the sequence of the first or second strand of AD-26917, and wherein the first and/or second strand further comprises up to about 20 additional nucleotides.

A RNAi agent comprising a first strand and a second strand, wherein the sequence of the first or second strand is the sequence of the first or second strand of AD-26794, and wherein the first and/or second strand further comprises up to about 20 additional nucleotides.

A RNAi agent comprising a first strand and a second strand, wherein the sequence of the first or second strand is the sequence of the first or second strand of AD-26910, and wherein the first and/or second strand further comprises up to about 20 additional nucleotides.

A RNAi agent comprising a first strand and a second strand, wherein the sequence of the first or second strand is the sequence of the first or second strand of AD-25939, and wherein the first and/or second strand further comprises up to about 20 additional nucleotides.

A RNAi agent comprising a first strand and a second strand, wherein the sequence of the first or second strand is the sequence of the first or second strand of AD-26032, and wherein the first and/or second strand further comprises up to about 20 additional nucleotides.

A RNAi agent comprising a first strand and a second strand, wherein the sequence of the first or second strand is the sequence of the first or second strand of AD-26776, and wherein the first and/or second strand further comprises up to about 20 additional nucleotides.

A RNAi agent comprising a first strand and a second strand, wherein the sequence of the first or second strand is the sequence of the first or second strand of AD-26806, and wherein the first and/or second strand further comprises up to about 20 additional nucleotides.

A RNAi agent comprising a first strand and a second strand, wherein the sequence of the first or second strand is the sequence of the first or second strand of AD-26748, and wherein the first and/or second strand further comprises up to about 20 additional nucleotides.

A RNAi agent comprising a first strand and a second strand, wherein the sequence of the first or second strand is the sequence of the first or second strand of AD-26725, and wherein the first and/or second strand further comprises up to about 20 additional nucleotides.

A RNAi agent comprising a first strand and a second strand, wherein the sequence of the first or second strand is the sequence of the first or second strand of AD-18958, and wherein the first and/or second strand further comprises up to about 20 additional nucleotides.

A RNAi agent comprising a first strand and a second strand, wherein the sequence of the first or second strand is the sequence of the first or second strand of AD-26672, and wherein the first and/or second strand further comprises up to about 20 additional nucleotides.

A RNAi agent comprising a first strand and a second strand, wherein the sequence of the first or second strand is the sequence of the first or second strand of AD-26905, and wherein the first and/or second strand further comprises up to about 20 additional nucleotides.

A RNAi agent comprising a first strand and a second strand, wherein the sequence of the first or second strand is the sequence of the first or second strand of AD-19056, and wherein the first and/or second strand further comprises up to about 20 additional nucleotides.

A RNAi agent comprising a first strand and a second strand, wherein the sequence of the first or second strand is the sequence of the first or second strand of AD-19762, and wherein the first and/or second strand further comprises up to about 20 additional nucleotides.

A RNAi agent comprising a first strand and a second strand, wherein the sequence of the first or second strand is the sequence of the first or second strand of AD-26919, and wherein the first and/or second strand further comprises up to about 20 additional nucleotides.

A RNAi agent comprising a first strand and a second strand, wherein the sequence of the first or second strand is the sequence of the first or second strand of AD-18946, and wherein the first and/or second strand further comprises up to about 20 additional nucleotides.

A RNAi agent comprising a first strand and a second strand, wherein the sequence of the first or second strand is the sequence of the first or second strand of AD-19066, and wherein the first and/or second strand further comprises up to about 20 additional nucleotides.

A RNAi agent comprising a first strand and a second strand, wherein the sequence of the first or second strand is the sequence of the first or second strand of AD-19746, and wherein the first and/or second strand further comprises up to about 20 additional nucleotides.

A RNAi agent comprising a first strand and a second strand, wherein the sequence of the first or second strand is the sequence of the first or second strand of AD-26057, and wherein the first and/or second strand further comprises up to about 20 additional nucleotides.

A RNAi agent comprising a first strand and a second strand, wherein the sequence of the first or second strand is the sequence of the first or second strand of AD-26073, and wherein the first and/or second strand further comprises up to about 20 additional nucleotides.

A RNAi agent comprising a first strand and a second strand, wherein the sequence of the first or second strand is the sequence of the first or second strand of AD-26689, and wherein the first and/or second strand further comprises up to about 20 additional nucleotides.

A RNAi agent comprising a first strand and a second strand, wherein the sequence of the first or second strand is the sequence of the first or second strand of AD-19008, and wherein the first and/or second strand further comprises up to about 20 additional nucleotides.

A RNAi agent comprising a first strand and a second strand, wherein the sequence of the first or second strand is the sequence of the first or second strand of AD-26026, and wherein the first and/or second strand further comprises up to about 20 additional nucleotides.

A RNAi agent comprising a first strand and a second strand, wherein the sequence of the first or second strand is the sequence of the first or second strand of AD-26761, and wherein the first and/or second strand further comprises up to about 20 additional nucleotides.

A RNAi agent comprising a first strand and a second strand, wherein the sequence of the first or second strand is the sequence of the first or second strand of AD-19752, and wherein the first and/or second strand further comprises up to about 20 additional nucleotides.

A RNAi agent comprising a first strand and a second strand, wherein the sequence of the first or second strand is the sequence of the first or second strand of AD-18981, and wherein the first and/or second strand further comprises up to about 20 additional nucleotides.

A RNAi agent comprising a first strand and a second strand, wherein the sequence of the first or second strand is the sequence of the first or second strand of AD-18927, and wherein the first and/or second strand further comprises up to about 20 additional nucleotides.

A RNAi agent comprising a first strand and a second strand, wherein the sequence of the first or second strand is the sequence of the first or second strand of AD-19753, and wherein the first and/or second strand further comprises up to about 20 additional nucleotides.

A RNAi agent comprising a first strand and a second strand, wherein the sequence of the first or second strand is the sequence of the first or second strand of AD-25907, and wherein the first and/or second strand further comprises up to about 20 additional nucleotides.

A RNAi agent comprising a first strand and a second strand, wherein the sequence of the first or second strand is the sequence of the first or second strand of AD-26671, and wherein the first and/or second strand further comprises up to about 20 additional nucleotides.

A RNAi agent comprising a first strand and a second strand, wherein the sequence of the first or second strand is the sequence of the first or second strand of AD-19080, and wherein the first and/or second strand further comprises up to about 20 additional nucleotides.

A RNAi agent comprising a first strand and a second strand, wherein the sequence of the first or second strand is the sequence of the first or second strand of AD-26075, and wherein the first and/or second strand further comprises up to about 20 additional nucleotides.

A RNAi agent comprising a first strand and a second strand, wherein the sequence of the first or second strand is the sequence of the first or second strand of AD-26681, and wherein the first and/or second strand further comprises up to about 20 additional nucleotides.

A RNAi agent comprising a first strand and a second strand, wherein the sequence of the first or second strand is the sequence of the first or second strand of AD-18976, and wherein the first and/or second strand further comprises up to about 20 additional nucleotides.

A RNAi agent comprising a first strand and a second strand, wherein the sequence of the first or second strand is the sequence of the first or second strand of AD-25900, and wherein the first and/or second strand further comprises up to about 20 additional nucleotides.

A RNAi agent comprising a first strand and a second strand, wherein the sequence of the first or second strand is the sequence of the first or second strand of AD-26126, and wherein the first and/or second strand further comprises up to about 20 additional nucleotides.

A RNAi agent comprising a first strand and a second strand, wherein the sequence of the first or second strand is the sequence of the first or second strand of AD-26688, and wherein the first and/or second strand further comprises up to about 20 additional nucleotides.

A RNAi agent comprising a first strand and a second strand, wherein the sequence of the first or second strand is the sequence of the first or second strand of AD-25912, and wherein the first and/or second strand further comprises up to about 20 additional nucleotides.

A RNAi agent comprising a first strand and a second strand, wherein the sequence of the first or second strand is the sequence of the first or second strand of AD-25930, and wherein the first and/or second strand further comprises up to about 20 additional nucleotides.

A RNAi agent comprising a first strand and a second strand, wherein the sequence of the first or second strand is the sequence of the first or second strand of AD-18995, and wherein the first and/or second strand further comprises up to about 20 additional nucleotides.

A RNAi agent comprising a first strand and a second strand, wherein the sequence of the first or second strand is the sequence of the first or second strand of AD-26802, and wherein the first and/or second strand further comprises up to about 20 additional nucleotides.

A RNAi agent comprising a first strand and a second strand, wherein the sequence of the first or second strand is the sequence of the first or second strand of AD-25892, and wherein the first and/or second strand further comprises up to about 20 additional nucleotides.

A RNAi agent comprising a first strand and a second strand, wherein the sequence of the first or second strand is the sequence of the first or second strand of AD-25947, and wherein the first and/or second strand further comprises up to about 20 additional nucleotides.

A RNAi agent comprising a first strand and a second strand, wherein the sequence of the first or second strand is the sequence of the first or second strand of AD-26088, and wherein the first and/or second strand further comprises up to about 20 additional nucleotides.

A RNAi agent comprising a first strand and a second strand, wherein the sequence of the first or second strand is the sequence of the first or second strand of AD-26098, and wherein the first and/or second strand further comprises up to about 20 additional nucleotides.

A RNAi agent comprising a first strand and a second strand, wherein the sequence of the first or second strand is the sequence of the first or second strand of AD-26778, and wherein the first and/or second strand further comprises up to about 20 additional nucleotides.

A RNAi agent comprising a first strand and a second strand, wherein the sequence of the first or second strand is the sequence of the first or second strand of AD-26215, and wherein the first and/or second strand further comprises up to about 20 additional nucleotides.

A RNAi agent comprising a first strand and a second strand, wherein the sequence of the first or second strand is the sequence of the first or second strand of AD-26739, and wherein the first and/or second strand further comprises up to about 20 additional nucleotides.

A RNAi agent comprising a first strand and a second strand, wherein the sequence of the first or second strand is the sequence of the first or second strand of AD-18950, and wherein the first and/or second strand further comprises up to about 20 additional nucleotides.

A RNAi agent comprising a first strand and a second strand, wherein the sequence of the first or second strand is the sequence of the first or second strand of AD-25949, and wherein the first and/or second strand further comprises up to about 20 additional nucleotides.

A RNAi agent comprising a first strand and a second strand, wherein the sequence of the first or second strand is the sequence of the first or second strand of AD-26141, and wherein the first and/or second strand further comprises up to about 20 additional nucleotides.

A RNAi agent comprising a first strand and a second strand, wherein the sequence of the first or second strand is the sequence of the first or second strand of AD-18961, and wherein the first and/or second strand further comprises up to about 20 additional nucleotides.

A RNAi agent comprising a first strand and a second strand, wherein the sequence of the first or second strand is the sequence of the first or second strand of AD-25957, and wherein the first and/or second strand further comprises up to about 20 additional nucleotides.

A RNAi agent comprising a first strand and a second strand, wherein the sequence of the first or second strand is the sequence of the first or second strand of AD-26826, and wherein the first and/or second strand further comprises up to about 20 additional nucleotides.

A RNAi agent comprising a first strand and a second strand, wherein the sequence of the first or second strand is the sequence of the first or second strand of AD-25963, and wherein the first and/or second strand further comprises up to about 20 additional nucleotides.

A RNAi agent comprising a first strand and a second strand, wherein the sequence of the first or second strand is the sequence of the first or second strand of AD-26019, and wherein the first and/or second strand further comprises up to about 20 additional nucleotides.

A RNAi agent comprising a first strand and a second strand, wherein the sequence of the first or second strand is the sequence of the first or second strand of AD-26035, and wherein the first and/or second strand further comprises up to about 20 additional nucleotides.

A RNAi agent comprising a first strand and a second strand, wherein the sequence of the first or second strand is the sequence of the first or second strand of AD-25946, and wherein the first and/or second strand further comprises up to about 20 additional nucleotides.

A RNAi agent comprising a first strand and a second strand, wherein the sequence of the first or second strand is the sequence of the first or second strand of AD-26714, and wherein the first and/or second strand further comprises up to about 20 additional nucleotides.

A RNAi agent comprising a first strand and a second strand, wherein the sequence of the first or second strand is the sequence of the first or second strand of AD-26022, and wherein the first and/or second strand further comprises up to about 20 additional nucleotides.

A RNAi agent comprising a first strand and a second strand, wherein the sequence of the first or second strand is the sequence of the first or second strand of AD-26096, and wherein the first and/or second strand further comprises up to about 20 additional nucleotides.

A RNAi agent comprising a first strand and a second strand, wherein the sequence of the first or second strand is the sequence of the first or second strand of AD-26132, and wherein the first and/or second strand further comprises up to about 20 additional nucleotides.

A RNAi agent comprising a first strand and a second strand, wherein the sequence of the first or second strand is the sequence of the first or second strand of AD-26062, and wherein the first and/or second strand further comprises up to about 20 additional nucleotides.

A RNAi agent comprising a first strand and a second strand, wherein the sequence of the first or second strand is the sequence of the first or second strand of AD-18991, and wherein the first and/or second strand further comprises up to about 20 additional nucleotides.

A RNAi agent comprising a first strand and a second strand, wherein the sequence of the first or second strand is the sequence of the first or second strand of AD-26164, and wherein the first and/or second strand further comprises up to about 20 additional nucleotides.

A RNAi agent comprising a first strand and a second strand, wherein the sequence of the first or second strand is the sequence of the first or second strand of AD-26209, and wherein the first and/or second strand further comprises up to about 20 additional nucleotides.

A RNAi agent comprising a first strand and a second strand, wherein the sequence of the first or second strand is the sequence of the first or second strand of AD-25895, and wherein the first and/or second strand further comprises up to about 20 additional nucleotides.

A RNAi agent comprising a first strand and a second strand, wherein the sequence of the first or second strand is the sequence of the first or second strand of AD-25933, and wherein the first and/or second strand further comprises up to about 20 additional nucleotides.

A RNAi agent comprising a first strand and a second strand, wherein the sequence of the first or second strand is the sequence of the first or second strand of AD-26017, and wherein the first and/or second strand further comprises up to about 20 additional nucleotides.

A RNAi agent comprising a first strand and a second strand, wherein the sequence of the first or second strand is the sequence of the first or second strand of AD-19749, and wherein the first and/or second strand further comprises up to about 20 additional nucleotides.

A RNAi agent comprising a first strand and a second strand, wherein the sequence of the first or second strand is the sequence of the first or second strand of AD-26653, and wherein the first and/or second strand further comprises up to about 20 additional nucleotides.

A RNAi agent comprising a first strand and a second strand, wherein the sequence of the first or second strand is the sequence of the first or second strand of AD-26759, and wherein the first and/or second strand further comprises up to about 20 additional nucleotides.

A RNAi agent comprising a first strand and a second strand, wherein the sequence of the first or second strand is the sequence of the first or second strand of AD-25924, and wherein the first and/or second strand further comprises up to about 20 additional nucleotides.

A RNAi agent comprising a first strand and a second strand, wherein the sequence of the first or second strand is the sequence of the first or second strand of AD-26153, and wherein the first and/or second strand further comprises up to about 20 additional nucleotides.

A RNAi agent comprising a first strand and a second strand, wherein the sequence of the first or second strand is the sequence of the first or second strand of AD-25953, and wherein the first and/or second strand further comprises up to about 20 additional nucleotides.

A RNAi agent comprising a first strand and a second strand, wherein the sequence of the first or second strand is the sequence of the first or second strand of AD-26764, and wherein the first and/or second strand further comprises up to about 20 additional nucleotides.

A RNAi agent comprising a first strand and a second strand, wherein the sequence of the first or second strand is the sequence of the first or second strand of AD-26790, and wherein the first and/or second strand further comprises up to about 20 additional nucleotides.

A RNAi agent comprising a first strand and a second strand, wherein the sequence of the first or second strand is the sequence of the first or second strand of AD-20124, and wherein the first and/or second strand further comprises up to about 20 additional nucleotides.

A RNAi agent comprising a first strand and a second strand, wherein the sequence of the first or second strand is the sequence of the first or second strand of AD-25919, and wherein the first and/or second strand further comprises up to about 20 additional nucleotides.

A RNAi agent comprising a first strand and a second strand, wherein the sequence of the first or second strand is the sequence of the first or second strand of AD-18913, and wherein the first and/or second strand further comprises up to about 20 additional nucleotides.

A RNAi agent comprising a first strand and a second strand, wherein the sequence of the first or second strand is the sequence of the first or second strand of AD-26211, and wherein the first and/or second strand further comprises up to about 20 additional nucleotides.

A RNAi agent comprising a first strand and a second strand, wherein the sequence of the first or second strand is the sequence of the first or second strand of AD-18936, and wherein the first and/or second strand further comprises up to about 20 additional nucleotides.

A RNAi agent comprising a first strand and a second strand, wherein the sequence of the first or second strand is the sequence of the first or second strand of AD-25898, and wherein the first and/or second strand further comprises up to about 20 additional nucleotides.

A RNAi agent comprising a first strand and a second strand, wherein the sequence of the first or second strand is the sequence of the first or second strand of AD-26741, and wherein the first and/or second strand further comprises up to about 20 additional nucleotides.

A RNAi agent comprising a first strand and a second strand, wherein the sequence of the first or second strand is the sequence of the first or second strand of AD-19043, and wherein the first and/or second strand further comprises up to about 20 additional nucleotides.

A RNAi agent comprising a first strand and a second strand, wherein the sequence of the first or second strand is the sequence of the first or second strand of AD-26079, and wherein the first and/or second strand further comprises up to about 20 additional nucleotides.

A RNAi agent comprising a first strand and a second strand, wherein the sequence of the first or second strand is the sequence of the first or second strand of AD-19000, and wherein the first and/or second strand further comprises up to about 20 additional nucleotides.

A RNAi agent comprising a first strand and a second strand, wherein the sequence of the first or second strand is the sequence of the first or second strand of AD-25911, and wherein the first and/or second strand further comprises up to about 20 additional nucleotides.

A RNAi agent comprising a first strand and a second strand, wherein the sequence of the first or second strand is the sequence of the first or second strand of AD-26786, and wherein the first and/or second strand further comprises up to about 20 additional nucleotides.

A RNAi agent comprising a first strand and a second strand, wherein the sequence of the first or second strand is the sequence of the first or second strand of AD-19069, and wherein the first and/or second strand further comprises up to about 20 additional nucleotides.

A RNAi agent comprising a first strand and a second strand, wherein the sequence of the first or second strand is the sequence of the first or second strand of AD-26037, and wherein the first and/or second strand further comprises up to about 20 additional nucleotides.

A RNAi agent comprising a first strand and a second strand, wherein the sequence of the first or second strand is the sequence of the first or second strand of AD-26723, and wherein the first and/or second strand further comprises up to about 20 additional nucleotides.

A RNAi agent comprising a first strand and a second strand, wherein the sequence of the first or second strand is the sequence of the first or second strand of AD-19067, and wherein the first and/or second strand further comprises up to about 20 additional nucleotides.

A RNAi agent comprising a first strand and a second strand, wherein the sequence of the first or second strand is the sequence of the first or second strand of AD-25928, and wherein the first and/or second strand further comprises up to about 20 additional nucleotides.

A RNAi agent comprising a first strand and a second strand, wherein the sequence of the first or second strand is the sequence of the first or second strand of AD-26677, and wherein the first and/or second strand further comprises up to about 20 additional nucleotides.

A RNAi agent comprising a first strand and a second strand, wherein the sequence of the first or second strand is the sequence of the first or second strand of AD-19006, and wherein the first and/or second strand further comprises up to about 20 additional nucleotides.

A RNAi agent comprising a first strand and a second strand, wherein the sequence of the first or second strand is the sequence of the first or second strand of AD-19758, and wherein the first and/or second strand further comprises up to about 20 additional nucleotides.

A RNAi agent comprising a first strand and a second strand, wherein the sequence of the first or second strand is the sequence of the first or second strand of AD-26913, and wherein the first and/or second strand further comprises up to about 20 additional nucleotides.

A RNAi agent comprising a first strand and a second strand, wherein the sequence of the first or second strand is the sequence of the first or second strand of AD-25917, and wherein the first and/or second strand further comprises up to about 20 additional nucleotides.

A RNAi agent comprising a first strand and a second strand, wherein the sequence of the first or second strand is the sequence of the first or second strand of AD-26189, and wherein the first and/or second strand further comprises up to about 20 additional nucleotides.

A RNAi agent comprising a first strand and a second strand, wherein the sequence of the first or second strand is the sequence of the first or second strand of AD-26787, and wherein the first and/or second strand further comprises up to about 20 additional nucleotides.

A RNAi agent comprising a first strand and a second strand, wherein the sequence of the first or second strand is the sequence of the first or second strand of AD-26707, and wherein the first and/or second strand further comprises up to about 20 additional nucleotides.

A RNAi agent comprising a first strand and a second strand, wherein the sequence of the first or second strand is the sequence of the first or second strand of AD-26094, and wherein the first and/or second strand further comprises up to about 20 additional nucleotides.

A RNAi agent comprising a first strand and a second strand, wherein the sequence of the first or second strand is the sequence of the first or second strand of AD-26097, and wherein the first and/or second strand further comprises up to about 20 additional nucleotides.

A RNAi agent comprising a first strand and a second strand, wherein the sequence of the first or second strand is the sequence of the first or second strand of AD-26699, and wherein the first and/or second strand further comprises up to about 20 additional nucleotides.

A RNAi agent comprising a first strand and a second strand, wherein the sequence of the first or second strand is the sequence of the first or second strand of AD-26756, and wherein the first and/or second strand further comprises up to about 20 additional nucleotides.

A RNAi agent comprising a first strand and a second strand, wherein the sequence of the first or second strand is the sequence of the first or second strand of AD-26720, and wherein the first and/or second strand further comprises up to about 20 additional nucleotides.

A RNAi agent comprising a first strand and a second strand, wherein the sequence of the first or second strand is the sequence of the first or second strand of AD-25926, and wherein the first and/or second strand further comprises up to about 20 additional nucleotides.

A RNAi agent comprising a first strand and a second strand, wherein the sequence of the first or second strand is the sequence of the first or second strand of AD-26212, and wherein the first and/or second strand further comprises up to about 20 additional nucleotides.

A RNAi agent comprising a first strand and a second strand, wherein the sequence of the first or second strand is the sequence of the first or second strand of AD-26687, and wherein the first and/or second strand further comprises up to about 20 additional nucleotides.

A RNAi agent comprising a first strand and a second strand, wherein the sequence of the first or second strand is the sequence of the first or second strand of AD-26753, and wherein the first and/or second strand further comprises up to about 20 additional nucleotides.

A RNAi agent comprising a first strand and a second strand, wherein the sequence of the first or second strand is the sequence of the first or second strand of AD-18982, and wherein the first and/or second strand further comprises up to about 20 additional nucleotides.

A RNAi agent comprising a first strand and a second strand, wherein the sequence of the first or second strand is the sequence of the first or second strand of AD-18908, and wherein the first and/or second strand further comprises up to about 20 additional nucleotides.

A RNAi agent comprising a first strand and a second strand, wherein the sequence of the first or second strand is the sequence of the first or second strand of AD-18968, and wherein the first and/or second strand further comprises up to about 20 additional nucleotides.

A RNAi agent comprising a first strand and a second strand, wherein the sequence of the first or second strand is the sequence of the first or second strand of AD-25948, and wherein the first and/or second strand further comprises up to about 20 additional nucleotides.

A RNAi agent comprising a first strand and a second strand, wherein the sequence of the first or second strand is the sequence of the first or second strand of AD-26188, and wherein the first and/or second strand further comprises up to about 20 additional nucleotides.

A RNAi agent comprising a first strand and a second strand, wherein the sequence of the first or second strand is the sequence of the first or second strand of AD-26708, and wherein the first and/or second strand further comprises up to about 20 additional nucleotides.

A RNAi agent comprising a first strand and a second strand, wherein the sequence of the first or second strand is the sequence of the first or second strand of AD-25961, and wherein the first and/or second strand further comprises up to about 20 additional nucleotides.

A RNAi agent comprising a first strand and a second strand, wherein the sequence of the first or second strand is the sequence of the first or second strand of AD-26803, and wherein the first and/or second strand further comprises up to about 20 additional nucleotides.

A RNAi agent comprising a first strand and a second strand, wherein the sequence of the first or second strand is the sequence of the first or second strand of AD-19741, and wherein the first and/or second strand further comprises up to about 20 additional nucleotides.

A RNAi agent comprising a first strand and a second strand, wherein the sequence of the first or second strand is the sequence of the first or second strand of AD-26056, and wherein the first and/or second strand further comprises up to about 20 additional nucleotides.

A RNAi agent comprising a first strand and a second strand, wherein the sequence of the first or second strand is the sequence of the first or second strand of AD-25959, and wherein the first and/or second strand further comprises up to about 20 additional nucleotides.

A RNAi agent comprising a first strand and a second strand, wherein the sequence of the first or second strand is the sequence of the first or second strand of AD-26059, and wherein the first and/or second strand further comprises up to about 20 additional nucleotides.

A RNAi agent comprising a first strand and a second strand, wherein the sequence of the first or second strand is the sequence of the first or second strand of AD-26102, and wherein the first and/or second strand further comprises up to about 20 additional nucleotides.

A RNAi agent comprising a first strand and a second strand, wherein the sequence of the first or second strand is the sequence of the first or second strand of AD-26106, and wherein the first and/or second strand further comprises up to about 20 additional nucleotides.

A RNAi agent comprising a first strand and a second strand, wherein the sequence of the first or second strand is the sequence of the first or second strand of AD-26744, and wherein the first and/or second strand further comprises up to about 20 additional nucleotides.

A RNAi agent comprising a first strand and a second strand, wherein the sequence of the first or second strand is the sequence of the first or second strand of AD-26099, and wherein the first and/or second strand further comprises up to about 20 additional nucleotides.

A RNAi agent comprising a first strand and a second strand, wherein the sequence of the first or second strand is the sequence of the first or second strand of AD-26170, and wherein the first and/or second strand further comprises up to about 20 additional nucleotides.

A RNAi agent comprising a first strand and a second strand, wherein the sequence of the first or second strand is the sequence of the first or second strand of AD-19012, and wherein the first and/or second strand further comprises up to about 20 additional nucleotides.

A RNAi agent comprising a first strand and a second strand, wherein the sequence of the first or second strand is the sequence of the first or second strand of AD-26198, and wherein the first and/or second strand further comprises up to about 20 additional nucleotides.

A RNAi agent comprising a first strand and a second strand, wherein the sequence of the first or second strand is the sequence of the first or second strand of AD-26766, and wherein the first and/or second strand further comprises up to about 20 additional nucleotides.

A RNAi agent comprising a first strand and a second strand, wherein the sequence of the first or second strand is the sequence of the first or second strand of AD-18951, and wherein the first and/or second strand further comprises up to about 20 additional nucleotides.

A RNAi agent comprising a first strand and a second strand, wherein the sequence of the first or second strand is the sequence of the first or second strand of AD-18975, and wherein the first and/or second strand further comprises up to about 20 additional nucleotides.

A RNAi agent comprising a first strand and a second strand, wherein the sequence of the first or second strand is the sequence of the first or second strand of AD-26749, and wherein the first and/or second strand further comprises up to about 20 additional nucleotides.

A RNAi agent comprising a first strand and a second strand, wherein the sequence of the first or second strand is the sequence of the first or second strand of AD-18911, and wherein the first and/or second strand further comprises up to about 20 additional nucleotides.

A RNAi agent comprising a first strand and a second strand, wherein the sequence of the first or second strand is the sequence of the first or second strand of AD-26906, and wherein the first and/or second strand further comprises up to about 20 additional nucleotides.

A RNAi agent comprising a first strand and a second strand, wherein the sequence of the first or second strand is the sequence of the first or second strand of AD-19747, and wherein the first and/or second strand further comprises up to about 20 additional nucleotides.

A RNAi agent comprising a first strand and a second strand, wherein the sequence of the first or second strand is the sequence of the first or second strand of AD-18960, and wherein the first and/or second strand further comprises up to about 20 additional nucleotides.

A RNAi agent comprising a first strand and a second strand, wherein the sequence of the first or second strand is the sequence of the first or second strand of AD-25909, and wherein the first and/or second strand further comprises up to about 20 additional nucleotides.

A RNAi agent comprising a first strand and a second strand, wherein the sequence of the first or second strand is the sequence of the first or second strand of AD-26184, and wherein the first and/or second strand further comprises up to about 20 additional nucleotides.

A RNAi agent comprising a first strand and a second strand, wherein the sequence of the first or second strand is the sequence of the first or second strand of AD-26077, and wherein the first and/or second strand further comprises up to about 20 additional nucleotides.

A RNAi agent comprising a first strand and a second strand, wherein the sequence of the first or second strand is the sequence of the first or second strand of AD-26680, and wherein the first and/or second strand further comprises up to about 20 additional nucleotides.

A RNAi agent comprising a first strand and a second strand, wherein the sequence of the first or second strand is the sequence of the first or second strand of AD-26085, and wherein the first and/or second strand further comprises up to about 20 additional nucleotides.

A RNAi agent comprising a first strand and a second strand, wherein the sequence of the first or second strand is the sequence of the first or second strand of AD-18926, and wherein the first and/or second strand further comprises up to about 20 additional nucleotides.

A RNAi agent comprising a first strand and a second strand, wherein the sequence of the first or second strand is the sequence of the first or second strand of AD-18945, and wherein the first and/or second strand further comprises up to about 20 additional nucleotides.

A RNAi agent comprising a first strand and a second strand, wherein the sequence of the first or second strand is the sequence of the first or second strand of AD-26703, and wherein the first and/or second strand further comprises up to about 20 additional nucleotides.

A RNAi agent comprising a first strand and a second strand, wherein the sequence of the first or second strand is the sequence of the first or second strand of AD-26911, and wherein the first and/or second strand further comprises up to about 20 additional nucleotides.

A RNAi agent comprising a first strand and a second strand, wherein the sequence of the first or second strand is the sequence of the first or second strand of AD-26661, and wherein the first and/or second strand further comprises up to about 20 additional nucleotides.

A RNAi agent comprising a first strand and a second strand, wherein the sequence of the first or second strand is the sequence of the first or second strand of AD-18905, and wherein the first and/or second strand further comprises up to about 20 additional nucleotides.

A RNAi agent comprising a first strand and a second strand, wherein the sequence of the first or second strand is the sequence of the first or second strand of AD-26142, and wherein the first and/or second strand further comprises up to about 20 additional nucleotides.

A RNAi agent comprising: a first strand and a second strand, wherein the sequence of the first or second strand is the sequence of the first or second strand of Set1_1245, and wherein the first and/or second strand further comprises up to about 20 additional nucleotides.

A RNAi agent comprising: a first strand and a second strand, wherein the sequence of the first or second strand is the sequence of the first or second strand of Set1_1249, and wherein the first and/or second strand further comprises up to about 20 additional nucleotides.

A RNAi agent comprising: a first strand and a second strand, wherein the sequence of the first or second strand is the sequence of the first or second strand of Set1_1250, and wherein the first and/or second strand further comprises up to about 20 additional nucleotides.

A RNAi agent comprising: a first strand and a second strand, wherein the sequence of the first or second strand is the sequence of the first or second strand of Set1_1450, and wherein the first and/or second strand further comprises up to about 20 additional nucleotides.

A RNAi agent comprising: a first strand and a second strand, wherein the sequence of the first or second strand is the sequence of the first or second strand of Set1_1545, and wherein the first and/or second strand further comprises up to about 20 additional nucleotides.

A RNAi agent comprising: a first strand and a second strand, wherein the sequence of the first or second strand is the sequence of the first or second strand of Set1_1755, and wherein the first and/or second strand further comprises up to about 20 additional nucleotides.

A RNAi agent comprising: a first strand and a second strand, wherein the sequence of the first or second strand is the sequence of the first or second strand of Set1_1814, and wherein the first and/or second strand further comprises up to about 20 additional nucleotides.

A RNAi agent comprising: a first strand and a second strand, wherein the sequence of the first or second strand is the sequence of the first or second strand of Set1_1816, and wherein the first and/or second strand further comprises up to about 20 additional nucleotides.

A RNAi agent comprising: a first strand and a second strand, wherein the sequence of the first or second strand is the sequence of the first or second strand of Set1_1974, and wherein the first and/or second strand further comprises up to about 20 additional nucleotides.

A RNAi agent comprising: a first strand and a second strand, wherein the sequence of the first or second strand is the sequence of the first or second strand of Set1_2202, and wherein the first and/or second strand further comprises up to about 20 additional nucleotides.

A RNAi agent comprising: a first strand and a second strand, wherein the sequence of the first or second strand is the sequence of the first or second strand of Set1_2425, and wherein the first and/or second strand further comprises up to about 20 additional nucleotides.

A RNAi agent comprising: a first strand and a second strand, wherein the sequence of the first or second strand is the sequence of the first or second strand of Set1_254, and wherein the first and/or second strand further comprises up to about 20 additional nucleotides.

A RNAi agent comprising: a first strand and a second strand, wherein the sequence of the first or second strand is the sequence of the first or second strand of Set1_3146, and wherein the first and/or second strand further comprises up to about 20 additional nucleotides.

A RNAi agent comprising: a first strand and a second strand, wherein the sequence of the first or second strand is the sequence of the first or second strand of Set1_3169, and wherein the first and/or second strand further comprises up to about 20 additional nucleotides.

A RNAi agent comprising: a first strand and a second strand, wherein the sequence of the first or second strand is the sequence of the first or second strand of Set1_3196, and wherein the first and/or second strand further comprises up to about 20 additional nucleotides.

A RNAi agent comprising: a first strand and a second strand, wherein the sequence of the first or second strand is the sequence of the first or second strand of Set1_3477, and wherein the first and/or second strand further comprises up to about 20 additional nucleotides.

A RNAi agent comprising: a first strand and a second strand, wherein the sequence of the first or second strand is the sequence of the first or second strand of Set1_703, and wherein the first and/or second strand further comprises up to about 20 additional nucleotides.

A RNAi agent comprising: a first strand and a second strand, wherein the sequence of the first or second strand is the sequence of the first or second strand of Set1_709, and wherein the first and/or second strand further comprises up to about 20 additional nucleotides.

A RNAi agent comprising: a first strand and a second strand, wherein the sequence of the first or second strand is the sequence of the first or second strand of Set1_865, and wherein the first and/or second strand further comprises up to about 20 additional nucleotides.

A RNAi agent comprising: a first strand and a second strand, wherein the sequence of the first or second strand is the sequence of the first or second strand of Set1_889, and wherein the first and/or second strand further comprises up to about 20 additional nucleotides.

A RNAi agent comprising: a first strand and a second strand, wherein the sequence of the first or second strand is the sequence of the first or second strand of Set1_895, and wherein the first and/or second strand further comprises up to about 20 additional nucleotides.

Additional Embodiments of Specific RNAi Agents to Beta-Catenin.

In various embodiments, the present disclosure pertains to:

A RNAi agent comprising a first strand and a second strand, wherein the sequence of the first strand and/or the second strand, respectively, is or consists of the sequence of SEQ ID NOs: 6096 and/or 6117, or modified or unmodified variants thereof.

A RNAi agent comprising a first strand and a second strand, wherein the sequence of the first strand and/or the second strand, respectively, is or consists of the sequence of SEQ ID NOs: 6097 and/or 6118, or modified or unmodified variants thereof.

A RNAi agent comprising a first strand and a second strand, wherein the sequence of the first strand and/or the second strand, respectively, is or consists of the sequence of SEQ ID NOs: 6098 and/or 6119, or modified or unmodified variants thereof.

A RNAi agent comprising a first strand and a second strand, wherein the sequence of the first strand and/or the second strand, respectively, is or consists of the sequence of SEQ ID NOs: 6100 and/or 6121, or modified or unmodified variants thereof.

A RNAi agent comprising a first strand and a second strand, wherein the sequence of the first strand and/or the second strand, respectively, is or consists of the sequence of SEQ ID NOs: 6101 and/or 6122, or modified or unmodified variants thereof.

A RNAi agent comprising a first strand and a second strand, wherein the sequence of the first strand and/or the second strand, respectively, is or consists of the sequence of SEQ ID NOs: 6103 and/or 6124, or modified or unmodified variants thereof.

A RNAi agent comprising a first strand and a second strand, wherein the sequence of the first strand and/or the second strand, respectively, is or consists of the sequence of SEQ ID NOs: 6105 and/or 6126, or modified or unmodified variants thereof.

A RNAi agent comprising a first strand and a second strand, wherein the sequence of the first strand and/or the second strand, respectively, is or consists of the sequence of SEQ ID NOs: 6106 and/or 6127, or modified or unmodified variants thereof.

A RNAi agent comprising a first strand and a second strand, wherein the sequence of the first strand and/or the second strand, respectively, is or consists of the sequence of SEQ ID NOs: 6107 and/or 6128, or modified or unmodified variants thereof.

A RNAi agent comprising a first strand and a second strand, wherein the sequence of the first strand and/or the second strand, respectively, comprise the sequence of SEQ ID NOs: 6096 and/or 6117, wherein the first and second strand are each no more than about 30 nucleotides in length, or unmodified variants thereof.

A RNAi agent comprising a first strand and a second strand, wherein the sequence of the first strand and/or the second strand, respectively, comprise the sequence of SEQ ID NOs: 6097 and/or 6118, wherein the first and second strand are each no more than about 30 nucleotides in length, or unmodified variants thereof.

A RNAi agent comprising a first strand and a second strand, wherein the sequence of the first strand and/or the second strand, respectively, comprise the sequence of SEQ ID NOs: 6098 and/or 6119, wherein the first and second strand are each no more than about 30 nucleotides in length, or unmodified variants thereof.

A RNAi agent comprising a first strand and a second strand, wherein the sequence of the first strand and/or the second strand, respectively, comprise the sequence of SEQ ID NOs: 6100 and/or 6121, wherein the first and second strand are each no more than about 30 nucleotides in length, or unmodified variants thereof.

A RNAi agent comprising a first strand and a second strand, wherein the sequence of the first strand and/or the second strand, respectively, comprise the sequence of SEQ ID NOs: 6101 and/or 6122, wherein the first and second strand are each no more than about 30 nucleotides in length, or unmodified variants thereof.

A RNAi agent comprising a first strand and a second strand, wherein the sequence of the first strand and/or the second strand, respectively, comprise the sequence of SEQ ID NOs: 6103 and/or 6124, wherein the first and second strand are each no more than about 30 nucleotides in length, or unmodified variants thereof.

A RNAi agent comprising a first strand and a second strand, wherein the sequence of the first strand and/or the second strand, respectively, comprise the sequence of SEQ ID NOs: 6105 and/or 6126, wherein the first and second strand are each no more than about 30 nucleotides in length, or unmodified variants thereof.

A RNAi agent comprising a first strand and a second strand, wherein the sequence of the first strand and/or the second strand, respectively, comprise the sequence of SEQ ID NOs: 6106 and/or 6127, wherein the first and second strand are each no more than about 30 nucleotides in length, or unmodified variants thereof.

A RNAi agent comprising a first strand and a second strand, wherein the sequence of the first strand and/or the second strand, respectively, comprise the sequence of SEQ ID NOs: 6107 and/or 6128, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides of the sequence of SEQ ID NOs: 6096 and/or 6117, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides of the sequence of SEQ ID NOs: 6097 and/or 6118, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides of the sequence of SEQ ID NOs: 6098 and/or 6119, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides of the sequence of SEQ ID NOs: 6100 and/or 6121, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides of the sequence of SEQ ID NOs: 6101 and/or 6122, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides of the sequence of SEQ ID NOs: 6103 and/or 6124, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides of the sequence of SEQ ID NOs: 6105 and/or 6126, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides of the sequence of SEQ ID NOs: 6106 and/or 6127, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides of the sequence of SEQ ID NOs: 6107 and/or 6128, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides differing by 0, 1, 2 or 3 nucleotides from the sequence of SEQ ID NOs: 6096 and/or 6117, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides differing by 0, 1, 2 or 3 nucleotides from the sequence of SEQ ID NOs: 6097 and/or 6118, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides differing by 0, 1, 2 or 3 nucleotides from the sequence of SEQ ID NOs: 6098 and/or 6119, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides differing by 0, 1, 2 or 3 nucleotides from the sequence of SEQ ID NOs: 6100 and/or 6121, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides differing by 0, 1, 2 or 3 nucleotides from the sequence of SEQ ID NOs: 6101 and/or 6122, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides differing by 0, 1, 2 or 3 nucleotides from the sequence of SEQ ID NOs: 6103 and/or 6124, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides differing by 0, 1, 2 or 3 nucleotides from the sequence of SEQ ID NOs: 6105 and/or 6126, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides differing by 0, 1, 2 or 3 nucleotides from the sequence of SEQ ID NOs: 6106 and/or 6127, wherein the first and second strand are each no more than about 30 nucleotides in length, or unmodified variants thereof.

A RNAi agent comprising a first strand and a second strand, wherein the sequence of the first strand and/or the second strand, respectively, comprise at least 15 contiguous nucleotides differing by 0, 1, 2 or 3 nucleotides from the sequence of SEQ ID NOs: 6107 and/or 6128, wherein the first and second strand are each no more than about 30 nucleotides in length, or unmodified variants thereof.

In various embodiments, the first and second strand can be either the sense and anti-sense strand, or the anti-sense and sense strand.

Additional Embodiments of Specific RNAi Agents to Beta-Catenin, Further Comprising Additional nt.

In various embodiments of the present disclosure, the RNAi agent comprises an anti-sense strand consisting of a sequence of at least 15 contiguous nucleotides with 0, 1, 2, or 3 mismatches from that of the anti-sense strand of any RNAi agent from Tables 1, 2, 3, 4, 5, 6, 7, 8 and/or 9, or modified or unmodified variants thereof, wherein the antisense strand optionally further comprises 0, 1, 2, 3, 4, 5, 6, 7, 8, 9, or 10 or more nt (or any range thereof, e.g., 0-1, 1-2, 1-3, 1-4, 1-5, 1-6, 1-7, 1-8, 1-9, 1-10, 2-3, 2-4, or 2-5 nt, etc.)

Additional Embodiments Comprising Overlapping Groups of RNAi Agents to Beta-Catenin In various embodiments of the present disclosure, the present disclosure relates to groups of RNAi agents with overlapping sequences. Thus, the present disclosure encompasses groups of RNAi agents wherein each RNAi agent in the group overlaps with each other RNAi agent in the same group by at least 5, 6, 7, 8, 9, 10, 11, 12, 13, 14, 15, 16, 17, 18, 19 or more nucleotides. In one embodiment, the overlap is at least 12 nt. Groups of sequences that overlap are shown in Table 4.

Table 4 shows, for example, that AD-26022 and AD-26204 share the common technical feature of the sequence of CCUGUUCCCUG (SEQ ID NO: 1319) in the sense strand, and the sequence of CAGGGGAACAGG (SEQ ID NO: 2714) in the anti-sense strand. Note of course that only a 12-nt portion of the overlap is shown; many groups of RNAi agents will overlap by more than 12 nt. The position within the gene is also indicated.

The present disclosure thus encompasses various embodiments comprising groups of overlapping RNAi agents, for example (1) RNAi agents comprising the sequences of AD-26022 and AD-26204; (2) RNAi agents consisting of the sequences of AD-26022 and AD-26204; (3) RNAi agents comprising a sense strand and/or a anti-sense strand comprising a sequence of AD-26022 and AD-26204; (4) RNAi agents comprising a sense strand and/or a anti-sense strand comprising 15 contiguous nt with 0 to 3 mismatches from a sequence of AD-26022 and AD-26204; (5) RNAi agents comprising a sense strand comprising 15 contiguous nt with 0 to 3 mismatches from a sequence of AD-26022 and AD-26204; (6) RNAi agents comprising an anti-sense strand comprising 15 contiguous nt with 0 to 3 mismatches from a sequence of AD-26022 and AD-26204; etc. and similar embodiments reflecting all the overlapping groups of RNAi agents.

Thus, in various embodiments, the RNAi agents of the present disclosure comprise a sense strand and an anti-sense (which may optionally be covalently linked, linked via a loop or linker, or contiguous), wherein the sense and/or anti-sense strand consist of, consist essentially of, or comprise sequences of at least 15 contiguous nt with 0, 1, 2, or 3 nt or by mismatches of, the sense and/or anti-sense strand, respectively, of any one or more of the RNAi agents disclosed in Tables 1, 2, 3, 4, 5, 6, 7, 8 and/or 9 (or any member of a group of overlapping RNAi agents from Table 4), optionally further comprising 0-10 nt or bp.

Additional Definitions

The articles "a" and "an" as used herein and in the claims refer to one or more than one (at least one) of the grammatical object of the article.

The terms "RNAi agent," "RNAi agents", "RNAi agent(s)" and the like all refer without limitation to one or more RNAi agents of the present disclosure.

The designations of particular example duplexes of RNAi agents to Beta-Catenin disclosed herein on occasion have the suffix "b" followed by a number. This indicates a batch number. Thus, the suffix "b1" indicates "batch 1." Thus, a RNAi duplex designated, for example, "AD-18892-b1" is specifically from batch 1 and has the same sequence as any RNAi agent designated "AD-18892".

Unless defined otherwise, the technical and scientific terms used herein have the same meaning as that usually understood by a specialist familiar with the field to which the present disclosure belongs.

Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein.

Claims to the present disclosure are non-limiting and are provided below.

Although particular embodiments and claims have been disclosed herein in detail, this has been done by way of example for purposes of illustration only, and is not intended to be limiting with respect to the scope of the appended claims, or the scope of subject matter of claims of any corresponding future application. In particular, it is contemplated by the inventors that various substitutions, alterations, and modifications may be made to the present disclosure without departing from the spirit and scope of the present disclosure as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims. Redrafting of claim scope in later-filed corresponding applications may be due to limitations by the patent laws of various countries and should not be interpreted as giving up subject matter of the claims.

Various additional formulations and obvious variants of the described RNAi agents to Beta-Catenin can be devised by those of ordinary skill in the art. Non-limiting example RNAi agents to Beta-Catenin are described in the Examples below, which do not limit the scope of the present disclosure as described in the claims.

Example 1

Bioinformatics and Beta-Catenin RNAi Agent (siRNA) Sequences
Bioinformatics
Transcripts RNAi agent design is carried out to identify RNAi agents targeting the human Beta-Catenin gene (CTNNB1). The design uses the CTNNB1 transcript NM_001098210.1 from the NCBI (National Center for Biotechnology Information) Refseq collection. All RNAi agent duplexes are designed with 100% identity to all three human CTNNB1 transcripts (NM_001098210.1, NM_001098209.1, and NM_001904.3).

siRNA Design and Specificity Prediction

The predicted specificity of all possible 19-mers is predicted from each sequence. The CTNNB1 RNAi agents are used in a comprehensive search against the human transcriptome (defined as the set of NM_ and XM_records within the human NCBI Refseq set) using the FASTA algorithm. The perl script 'parseFasta.pl' is then used to parse the alignments and generate a score based on the position and number of mismatches between the siRNA and any potential 'off-target' transcript. The off-target score is weighted to emphasize differences in the 'seed' region of siRNAs, in positions 2-9 from the 5' end of the molecule. Each oligo-transcript pair from the FASTA search is given a mismatch score by summing the individual mismatch scores; mismatches in the position 2-9 are counted as 2.8, mismatches in the cleavage site positions 10-11 are counted as 1.2, and mismatches in region 12-19 counted as 1.0. An additional off-target prediction is carried out by comparing the frequency of heptamers and octomers derived from 3 distinct, seed-derived hexamers of each oligo. The hexamers from positions 2-7 relative to the 5' start is used to create 2 heptamers and one octomer. The 'heptamer1' is created by adding a 3' A to the hexamer; the heptamer2 is created by adding a 5' A to the hexamer; the octomer is created by adding an A to both 5' and 3' ends of the hexamer. The frequency of octomers and heptamers in the human 3'UTRome (defined as the subsequence of the transcriptome from NCBI's Refseq database where the end of the coding region, the 'CDS', is clearly defined) is pre-calculated. The octomer frequency is normalized to the heptamer frequency using the median value from the range of octomer frequencies. A 'mirSeedScore' is then calculated by calculating the sum of ((3× normalized octomer count)+(2× heptamer2 count)+(1× heptamer1 count)).

Both RNAi agent strands are assigned to a category of specificity according to the calculated scores: a score above 3 qualifies as highly specific, equal to 3 as specific and between 2.2 and 2.8 as moderately specific. RNAi agents are sorted by the specificity of the anti-sense strand. Oligonucleotides with perfect matches to known human microRNA seed regions are excluded.

TABLE 2

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
| --- | --- | --- | --- | --- | --- |
| AD-18892 | UGGUGCUGACUAUCCAGUU | 4771 | AACUGGAUAGUCAGCACCA | 5430 | 2500 |
| AD-18893 | CCAUCUGUGCUCUUCGUCA | 4772 | UGACGAAGAGCACAGAUGG | 5431 | 1659 |
| AD-18894 | AUAAGCAGGUGGAUCUAUU | 4773 | AAUAGAUCCACCUGCUUAU | 5432 | 3038 |
| AD-18895 | AUCCAAAGAGUAGCUGCAG | 4774 | CUGCAGCUACUCUUUGGAU | 5433 | 2096 |
| AD-18896 | GACAAUGGCUACUCAAGCU | 4775 | AGCUUGAGUAGCCAUUGUC | 5434 | 265 |
| AD-18897 | CUGUUGGAUUGAUUCGAAA | 4776 | UUUCGAAUCAAUCCAACAG | 5435 | 1797 |
| AD-18898 | GCUGGCCUGGUUUGAUACU | 4777 | AGUAUCAAACCAGGCCAGC | 5436 | 2587 |
| AD-18899 | UCUAACCUCACUUGCAAUA | 4778 | UAUUGCAAGUGAGGUUAGA | 5437 | 1541 |
| AD-18900 | GAUAUCGCCAGGAUGAUCC | 4779 | GGAUCAUCCUGGCGAUAUC | 5438 | 2391 |
| AD-18901 | UGGCCAUCUUUAAGUCUGG | 4780 | CCAGACUUAAAGAUGGCCA | 5439 | 954 |
| AD-18902 | UGUAGAACACUAAUUCAUA | 4781 | UAUGAAUUAGUGUUCUACA | 5440 | 2908 |
| AD-18903 | AUCAGUAAGAGGUGUUAUU | 4782 | AAUAACACCUCUUACUGAU | 5441 | 3104 |
| AD-18904 | GUGCUCUUCGUCAUCUGAC | 4783 | GUCAGAUGACGAAGAGCAC | 5442 | 1665 |
| AD-18905 | UGGUUUGAUACUGACCUGU | 4784 | ACAGGUCAGUAUCAAACCA | 5443 | 2594 |
| AD-18906 | CCAGUUGCCUUUUAUCCCA | 4785 | UGGGAUAAAAGGCAACUGG | 5444 | 3147 |
| AD-18907 | CCUGGUUUGAUACUGACCU | 4786 | AGGUCAGUAUCAAACCAGG | 5445 | 2592 |
| AD-18908 | GACUAUCCAGUUGAUGGGC | 4787 | GCCCAUCAACUGGAUAGUC | 5446 | 2507 |
| AD-18909 | AGCCAAUGGCUUGGAAUGA | 4788 | UCAUUCCAAGCCAUUGGCU | 5447 | 2325 |
| AD-18910 | GCCAAUGGCUUGGAAUGAG | 4789 | CUCAUUCCAAGCCAUUGGC | 5448 | 2326 |
| AD-18911 | AGAUGAGGGCAUGCAGAUC | 4790 | GAUCUGCAUGCCCUCAUCU | 5449 | 577 |
| AD-18912 | GGUCCUCUGUGAACUUGCU | 4791 | AGCAAGUUCACAGAGGACC | 5450 | 2116 |
| AD-18913 | AACCUAGCCUUGCUUGUU | 4792 | AACAAGCAAGGCUAGGGUU | 5451 | 2708 |
| AD-18914 | GAACACUAAUUCAUAAUCA | 4793 | UGAUUAUGAAUUAGUGUUC | 5452 | 2912 |
| AD-18915 | AUCAAACCCUAGCCUUGCU | 4794 | AGCAAGGCUAGGGUUUGAU | 5453 | 2704 |
| AD-18916 | ACCAGUUGCCUUUUAUCCC | 4795 | GGGAUAAAAGGCAACUGGU | 5454 | 3146 |
| AD-18917 | CUAACCUCACUUGCAAUAA | 4796 | UUAUUGCAAGUGAGGUUAG | 5455 | 1542 |
| AD-18918 | AUCCCACUAAUGUCCAGCG | 4797 | CGCUGGACAUUAGUGGGAU | 5456 | 621 |
| AD-18919 | CUGACUAUCCAGUUGAUGG | 4798 | CCAUCAACUGGAUAGUCAG | 5457 | 2505 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-18920 | GGCCUGGUUUGAUACUGAC | 4799 | GUCAGUAUCAAACCAGGCC | 5458 | 2590 |
| AD-18921 | GGUAAAUCAGUAAGAGGUG | 4800 | CACCUCUUACUGAUUUACC | 5459 | 3099 |
| AD-18922 | GCCUGGUUUGAUACUGACC | 4801 | GGUCAGUAUCAAACCAGGC | 5460 | 2591 |
| AD-18923 | CAGGGGUCCUCUGUGAACU | 4802 | AGUUCACAGAGGACCCCUG | 5461 | 2112 |
| AD-18925 | CUGGAAUCCAUUCUGGUGC | 4803 | GCACCAGAAUGGAUUCCAG | 5462 | 366 |
| AD-18926 | UGAGAUGGGUGGCCACCAC | 4804 | GUGGUGGCCACCCAUCUCA | 5463 | 2479 |
| AD-18927 | GAUGAUAUAAAUGUGGUCA | 4805 | UGACCACAUUUAUAUCAUC | 5464 | 1502 |
| AD-18928 | UGCUUUAUUCUCCCAUUGA | 4806 | UCAAUGGGAGAAUAAAGCA | 5465 | 2073 |
| AD-18929 | UUAUCAAACCCUAGCCUUG | 4807 | CAAGGCUAGGGUUUGAUAA | 5466 | 2702 |
| AD-18930 | CCACUGGCCUCUGAUAAAG | 4808 | CUUUAUCAGAGGCCAGUGG | 5467 | 1774 |
| AD-18931 | AACUUGCCACACGUGCAAU | 4809 | AUUGCACGUGUGGCAAGUU | 5468 | 708 |
| AD-18932 | GCUCUUCGUCAUCUGACCA | 4810 | UGGUCAGAUGACGAAGAGC | 5469 | 1667 |
| AD-18933 | GUAACAAUACAAAUGGAUU | 4811 | AAUCCAUUUGUAUUGUUAC | 5470 | 2629 |
| AD-18934 | GGGGUCCUCUGUGAACUUG | 4812 | CAAGUUCACAGAGGACCCC | 5471 | 2114 |
| AD-18935 | CAAACCCUAGCCUUGCUUG | 4813 | CAAGCAAGGCUAGGGUUUG | 5472 | 2706 |
| AD-18936 | GAGUAAUGGUGUAGAACAC | 4814 | GUGUUCUACACCAUUACUC | 5473 | 2899 |
| AD-18937 | GGAAGACAUCACUGAGCCU | 4815 | AGGCUCAGUGAUGUCUUCC | 5474 | 1639 |
| AD-18938 | GGGAAGACAUCACUGAGCC | 4816 | GGCUCAGUGAUGUCUUCCC | 5475 | 1638 |
| AD-18939 | GGUGUAGAACACUAAUUCA | 4817 | UGAAUUAGUGUUCUACACC | 5476 | 2906 |
| AD-18940 | UACCAGUUGCCUUUUAUCC | 4818 | GGAUAAAAGGCAACUGGUA | 5477 | 3145 |
| AD-18941 | GGAUAUCGCCAGGAUGAUC | 4819 | GAUCAUCCUGGCGAUAUCC | 5478 | 2390 |
| AD-18942 | AAACCCUAGCCUUGCUUGU | 4820 | ACAAGCAAGGCUAGGGUUU | 5479 | 2707 |
| AD-18943 | CUCUUCGUCAUCUGACCAG | 4821 | CUGGUCAGAUGACGAAGAG | 5480 | 1668 |
| AD-18944 | UGACUAUCCAGUUGAUGGG | 4822 | CCCAUCAACUGGAUAGUCA | 5481 | 2506 |
| AD-18945 | ACAAGCAGAGUGCUGAAGG | 4823 | CCUUCAGCACUCUGCUUGU | 5482 | 1286 |
| AD-18946 | CAUCUGUGCUCUUCGUCAU | 4824 | AUGACGAAGAGCACAGAUG | 5483 | 1660 |
| AD-18947 | CAAUGGCUUGGAAUGAGAC | 4825 | GUCUCAUUCCAAGCCAUUG | 5484 | 2328 |
| AD-18948 | ACUGGCCUCUGAUAAAGGC | 4826 | GCCUUUAUCAGAGGCCAGU | 5485 | 1776 |
| AD-18949 | UCAUCCCACUAAUGUCCAG | 4827 | CUGGACAUUAGUGGGAUGA | 5486 | 619 |
| AD-18950 | AAAAGGAAGCUUCCAGACA | 4828 | UGUCUGGAAGCUUCCUUUU | 5487 | 807 |
| AD-18951 | CGUUCUUUUCACUCUGGUG | 4829 | CACCAGAGUGAAAAGAACG | 5488 | 2417 |
| AD-18952 | AAAGUUGUUGUAACCUGCU | 4830 | AGCAGGUUACAACAACUUU | 5489 | 3165 |
| AD-18953 | ACAAUGGCUACUCAAGCUG | 4831 | CAGCUUGAGUAGCCAUUGU | 5490 | 266 |
| AD-18954 | CUCAUCCCACUAAUGUCCA | 4832 | UGGACAUUAGUGGGAUGAG | 5491 | 618 |
| AD-18955 | AGGGGUCCUCUGUGAACUU | 4833 | AAGUUCACAGAGGACCCCU | 5492 | 2113 |
| AD-18956 | AAGCAGGUGGAUCUAUUUC | 4834 | GAAAUAGAUCCACCUGCUU | 5493 | 3040 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-18957 | AAGUUGUUGUAACCUGCUG | 4835 | CAGCAGGUUACAACAACUU | 5494 | 3166 |
| AD-18958 | AGCAGGUGGAUCUAUUUCA | 4836 | UGAAAUAGAUCCACCUGCU | 5495 | 3041 |
| AD-18959 | AGGGCAUGCAGAUCCCAUC | 4837 | GAUGGGAUCUGCAUGCCCU | 5496 | 582 |
| AD-18960 | AAAUGGUUCAGAAUUAAAC | 4838 | GUUUAAUUCUGAACCAUUU | 5497 | 3220 |
| AD-18961 | UGAACUUGCUCAGGACAAG | 4839 | CUUGUCCUGAGCAAGUUCA | 5498 | 2125 |
| AD-18962 | AAGAGUAGCUGCAGGGGUC | 4840 | GACCCCUGCAGCUACUCUU | 5499 | 2101 |
| AD-18963 | CCCACUGGCCUCUGAUAAA | 4841 | UUUAUCAGAGGCCAGUGGG | 5500 | 1773 |
| AD-18964 | CUGGCCUGGUUUGAUACUG | 4842 | CAGUAUCAAACCAGGCCAG | 5501 | 2588 |
| AD-18965 | UUGAUACUGACCUGUAAAU | 4843 | AUUUACAGGUCAGUAUCAA | 5502 | 2598 |
| AD-18966 | GUGUAGAACACUAAUUCAU | 4844 | AUGAAUUAGUGUUCUACAC | 5503 | 2907 |
| AD-18967 | ACUAUCCAGUUGAUGGGCU | 4845 | AGCCCAUCAACUGGAUAGU | 5504 | 2508 |
| AD-18968 | AAAUCAGUAAGAGGUGUUA | 4846 | UAACACCUCUUACUGAUUU | 5505 | 3102 |
| AD-18969 | GCAGGUGGAUCUAUUUCAU | 4847 | AUGAAAUAGAUCCACCUGC | 5506 | 3042 |
| AD-18970 | CUGGUGCUGACUAUCCAGU | 4848 | ACUGGAUAGUCAGCACCAG | 5507 | 2499 |
| AD-18971 | GUGAACUUGCUCAGGACAA | 4849 | UUGUCCUGAGCAAGUUCAC | 5508 | 2124 |
| AD-18972 | UCAGUAAGAGGUGUUAUUU | 4850 | AAAUAACACCUCUUACUGA | 5509 | 3105 |
| AD-18973 | CCUCUGUGAACUUGCUCAG | 4851 | CUGAGCAAGUUCACAGAGG | 5510 | 2119 |
| AD-18974 | UUGGCUGAACCAUCACAGA | 4852 | UCUGUGAUGGUUCAGCCAA | 5511 | 641 |
| AD-18975 | UCAGCUGGCCUGGUUUGAU | 4853 | AUCAAACCAGGCCAGCUGA | 5512 | 2584 |
| AD-18976 | GUAGCUGCAGGGGUCCUCU | 4854 | AGAGGACCCCUGCAGCUAC | 5513 | 2105 |
| AD-18977 | AGGAGCUAAAAUGGCAGUG | 4855 | CACUGCCAUUUUAGCUCCU | 5514 | 1069 |
| AD-18978 | AUGGCUUGGAAUGAGACUG | 4856 | CAGUCUCAUUCCAAGCCAU | 5515 | 2330 |
| AD-18979 | UUGGAUAUCGCCAGGAUGA | 4857 | UCAUCCGGCGAUAUCCAA | 5516 | 2388 |
| AD-18980 | GGUUCAGAAUUAAACUUUU | 4858 | AAAAGUUUAAUUCUGAACC | 5517 | 3224 |
| AD-18981 | GGGUAAAUCAGUAAGAGGU | 4859 | ACCUCUUACUGAUUUACCC | 5518 | 3098 |
| AD-18982 | AUACCAUUCCAUUGUUUGU | 4860 | ACAAACAAUGGAAUGGUAU | 5519 | 2049 |
| AD-18983 | ACUGUUGGAUUGAUUCGAA | 4861 | UUCGAAUCAAUCCAACAGU | 5520 | 1796 |
| AD-18984 | AACUUGCUCAGGACAAGGA | 4862 | UCCUUGUCCUGAGCAAGUU | 5521 | 2127 |
| AD-18985 | AUGCUUAAAAUAAGCAGGU | 4863 | ACCUGCUUAUUUUAAGCAU | 5522 | 3029 |
| AD-18986 | GUUUGAUACUGACCUGUAA | 4864 | UUACAGGUCAGUAUCAAAC | 5523 | 2596 |
| AD-18987 | AAUGGUUCAGAAUUAAACU | 4865 | AGUUUAAUUCUGAACCAUU | 5524 | 3221 |
| AD-18988 | UAUCCCAAAGUUGUUGUAA | 4866 | UUACAACAACUUUGGGAUA | 5525 | 3159 |
| AD-18989 | AUCAGCUGGCCUGGUUUGA | 4867 | UCAAACCAGGCCAGCUGAU | 5526 | 2583 |
| AD-18990 | CCUGCCAUCUGUGCUCUUC | 4868 | GAAGAGCACAGAUGGCAGG | 5527 | 1655 |
| AD-18991 | GCAGAAUACAAAUGAUGUA | 4869 | UACAUCAUUUGUAUUCUGC | 5528 | 874 |
| AD-18992 | UAUGCUUAAAAUAAGCAGG | 4870 | CCUGCUUAUUUUAAGCAUA | 5529 | 3028 |
| AD-18993 | AAUAAGCAGGUGGAUCUAU | 4871 | AUAGAUCCACCUGCUUAUU | 5530 | 3037 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
| --- | --- | --- | --- | --- | --- |
| AD-18994 | UGAUAUAAAUGUGGUCACC | 4872 | GGUGACCACAUUUAUAUCA | 5531 | 1504 |
| AD-18995 | GUAGGGUAAAUCAGUAAGA | 4873 | UCUUACUGAUUUACCCUAC | 5532 | 3095 |
| AD-18996 | UAUCAAACCCUAGCCUUGC | 4874 | GCAAGGCUAGGGUUUGAUA | 5533 | 2703 |
| AD-18997 | CCUUUUAUCCCAAAGUUGU | 4875 | ACAACUUUGGGAUAAAAGG | 5534 | 3154 |
| AD-18998 | GGUAGGGUAAAUCAGUAAG | 4876 | CUUACUGAUUUACCCUACC | 5535 | 3094 |
| AD-18999 | UGAUACUGACCUGUAAAUC | 4877 | GAUUUACAGGUCAGUAUCA | 5536 | 2599 |
| AD-19000 | GGCUGAACCAUCACAGAUG | 4878 | CAUCUGUGAUGGUUCAGCC | 5537 | 643 |
| AD-19001 | UGGAUAUCGCCAGGAUGAU | 4879 | AUCAUCCUGGCGAUAUCCA | 5538 | 2389 |
| AD-19002 | UCUUCGUCAUCUGACCAGC | 4880 | GCUGGUCAGAUGACGAAGA | 5539 | 1669 |
| AD-19003 | UAGCUGCAGGGGUCCUCUG | 4881 | CAGAGGACCCCUGCAGCUA | 5540 | 2106 |
| AD-19004 | UGUUGUAACCUGCUGUGAU | 4882 | AUCACAGCAGGUUACAACA | 5541 | 3170 |
| AD-19005 | AAUCAGUAAGAGGUGUUAU | 4883 | AUAACACCUCUUACUGAUU | 5542 | 3103 |
| AD-19006 | UGGCUGAACCAUCACAGAU | 4884 | AUCUGUGAUGGUUCAGCCA | 5543 | 642 |
| AD-19007 | GAAUUAAACUUUUAAUUCA | 4885 | UGAAUUAAAAGUUUAAUUC | 5544 | 3230 |
| AD-19008 | AUGGUUCAGAAUUAAACUU | 4886 | AAGUUUAAUUCUGAACCAU | 5545 | 3222 |
| AD-19009 | UGGUGUAGAACACUAAUUC | 4887 | GAAUUAGUGUUCUACACCA | 5546 | 2905 |
| AD-19010 | AUGGUGUAGAACACUAAUU | 4888 | AAUUAGUGUUCUACACCAU | 5547 | 2904 |
| AD-19011 | AUGAGGGCAUGCAGAUCCC | 4889 | GGGAUCUGCAUGCCCUCAU | 5548 | 579 |
| AD-19012 | GUUGUAACCUGCUGUGAUA | 4890 | UAUCACAGCAGGUUACAAC | 5549 | 3171 |
| AD-19042 | GCUGACUAUCCAGUUGAUG | 4891 | CAUCAACUGGAUAGUCAGC | 5550 | 2504 |
| AD-19043 | UAAGCAGGUGGAUCUAUUU | 4892 | AAAUAGAUCCACCUGCUUA | 5551 | 3039 |
| AD-19044 | UAAAUAAGCAGGUGGAUC | 4893 | GAUCCACCUGCUUAUUUUA | 5552 | 3034 |
| AD-19045 | GAUAUAAAUGUGGUCACCU | 4894 | AGGUGACCACAUUUAUAUC | 5553 | 1505 |
| AD-19046 | AAGCAGAGUGCUGAAGGUG | 4895 | CACCUUCAGCACUCUGCUU | 5554 | 1288 |
| AD-19047 | UGUGAACUUGCUCAGGACA | 4896 | UGUCCUGAGCAAGUUCACA | 5555 | 2123 |
| AD-19048 | CAUCCCACUAAUGUCCAGC | 4897 | GCUGGACAUUAGUGGGAUG | 5556 | 620 |
| AD-19049 | CAAAGUUGUUGUAACCUGC | 4898 | GCAGGUUACAACAACUUUG | 5557 | 3164 |
| AD-19050 | UAAAUCAGUAAGAGGUGUU | 4899 | AACACCUCUUACUGAUUUA | 5558 | 3101 |
| AD-19051 | AAUGGCUUGGAAUGAGACU | 4900 | AGUCUCAUUCCAAGCCAUU | 5559 | 2329 |
| AD-19052 | GGGUCCUCUGUGAACUUGC | 4901 | GCAAGUUCACAGAGGACCC | 5560 | 2115 |
| AD-19053 | GAGUAACAAUACAAAUGGA | 4902 | UCCAUUUGUAUUGUUACUC | 5561 | 2627 |
| AD-19054 | UAAUGGUGUAGAACACUAA | 4903 | UUAGUGUUCUACACCAUUA | 5562 | 2902 |
| AD-19055 | GUGGACAAUGGCUACUCAA | 4904 | UUGAGUAGCCAUUGUCCAC | 5563 | 262 |
| AD-19056 | AACUGUCUUUGGACUCUCA | 4905 | UGAGAGUCCAAAGACAGUU | 5564 | 1406 |
| AD-19057 | CCCUGGUGCUGACUAUCCA | 4906 | UGGAUAGUCAGCACCAGGG | 5565 | 2497 |
| AD-19058 | CAGGUGGAUCUAUUUCAUG | 4907 | CAUGAAAUAGAUCCACCUG | 5566 | 3043 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-19059 | UGGCCUGGUUUGAUACUGA | 4908 | UCAGUAUCAAACCAGGCCA | 5567 | 2589 |
| AD-19060 | AGCUGGCCUGGUUUGAUAC | 4909 | GUAUCAAACCAGGCCAGCU | 5568 | 2586 |
| AD-19061 | GCCAUCUGUGCUCUUCGUC | 4910 | GACGAAGAGCACAGAUGGC | 5569 | 1658 |
| AD-19062 | UACCAUUCCAUUGUUUGUG | 4911 | CACAAACAAUGGAAUGGUA | 5570 | 2050 |
| AD-19063 | CCCUUGGAUAUCGCCAGGA | 4912 | UCCUGGCGAUAUCCAAGGG | 5571 | 2385 |
| AD-19064 | AGGGAAGACAUCACUGAGC | 4913 | GCUCAGUGAUGUCUUCCCU | 5572 | 1637 |
| AD-19065 | GAACUUGCCACACGUGCAA | 4914 | UUGCACGUGUGGCAAGUUC | 5573 | 707 |
| AD-19066 | UUUGAUACUGACCUGUAAA | 4915 | UUUACAGGUCAGUAUCAAA | 5574 | 2597 |
| AD-19067 | UCCCAAAGUUGUUGUAACC | 4916 | GGUUACAACAACUUUGGGA | 5575 | 3161 |
| AD-19068 | CAGAAUACAAAUGAUGUAG | 4917 | CUACAUCAUUUGUAUUCUG | 5576 | 875 |
| AD-19069 | AGGUGGAUCUAUUUCAUGU | 4918 | ACAUGAAAUAGAUCCACCU | 5577 | 3044 |
| AD-19070 | GCUCAUCCCACUAAUGUCC | 4919 | GGACAUUAGUGGGAUGAGC | 5578 | 617 |
| AD-19071 | CCUGGUGCUGACUAUCCAG | 4920 | CUGGAUAGUCAGCACCAGG | 5579 | 2498 |
| AD-19072 | UGGAAUCCAUUCUGGUGCC | 4921 | GGCACCAGAAUGGAUUCCA | 5580 | 367 |
| AD-19073 | CCAGGACCUCAUGGAUGGG | 4922 | CCCAUCCAUGAGGUCCUGG | 5581 | 2545 |
| AD-19074 | AACCUCACUUGCAAUAAUU | 4923 | AAUUAUUGCAAGUGAGGUU | 5582 | 1544 |
| AD-19075 | CAGUUGCCUUUUAUCCCAA | 4924 | UUGGGAUAAAAGGCAACUG | 5583 | 3148 |
| AD-19076 | GUAGAACACUAAUUCAUAA | 4925 | UUAUGAAUUAGUGUUCUAC | 5584 | 2909 |
| AD-19077 | CUAUCCAGUUGAUGGGCUG | 4926 | CAGCCCAUCAACUGGAUAG | 5585 | 2509 |
| AD-19078 | CACUGGCCUCUGAUAAAGG | 4927 | CCUUUAUCAGAGGCCAGUG | 5586 | 1775 |
| AD-19079 | ACUGUCUUUGGACUCUCAG | 4928 | CUGAGAGUCCAAAGACAGU | 5587 | 1407 |
| AD-19080 | CCAAUGGCUUGGAAUGAGA | 4929 | UCUCAUUCCAAGCCAUUGG | 5588 | 2327 |
| AD-19081 | GCUUAAAAUAAGCAGGUGG | 4930 | CCACCUGCUUAUUUUAAGC | 5589 | 3031 |
| AD-19082 | AUCUGUGCUCUUCGUCAUC | 4931 | GAUGACGAAGAGCACAGAU | 5590 | 1661 |
| AD-19083 | CCCAAAGUUGUUGUAACCU | 4932 | AGGUUACAACAACUUUGGG | 5591 | 3162 |
| AD-19738 | UACCCAGCGCCGUACGUCC | 4933 | GGACGUACGGCGCUGGGUA | 5592 | 1906 |
| AD-19739 | ACGCUAUCAUGCGUUCUCC | 4934 | GGAGAACGCAUGAUAGCGU | 5593 | 825 |
| AD-19740 | CAUGCACCUUUGCGUGAGC | 4935 | GCUCACGCAAAGGUGCAUG | 5594 | 1838 |
| AD-19741 | GAAUGCAGUUCGCCUUCAC | 4936 | GUGAAGGCGAACUGCAUUC | 5595 | 1714 |
| AD-19742 | GGUGCCAUUCCACGACUAG | 4937 | CUAGUCGUGGAAUGGCACC | 5596 | 1859 |
| AD-19743 | AAGCGGCUGUUAGUCACUG | 4938 | CAGUGACUAACAGCCGCUU | 5597 | 324 |
| AD-19744 | UCGAGCUCAGAGGGUACGA | 4939 | UCGUACCCUCUGAGCUCGA | 5598 | 535 |
| AD-19745 | GACACGCUAUCAUGCGUUC | 4940 | GAACGCAUGAUAGCGUGUC | 5599 | 822 |
| AD-19746 | CGCUAUCAUGCGUUCUCCU | 4941 | AGGAGAACGCAUGAUAGCG | 5600 | 826 |
| AD-19747 | GUGUCUGCUAUUGUACGUA | 4942 | UACGUACAAUAGCAGACAC | 5601 | 851 |
| AD-19748 | GUCUGCUCUAGUAAUAAGC | 4943 | GCUUAUUACUAGAGCAGAC | 5602 | 1313 |
| AD-19749 | GUGCCAUUCCACGACUAGU | 4944 | ACUAGUCGUGGAAUGGCAC | 5603 | 1860 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-19750 | AUGUUCACAACCGAAUUGU | 4945 | ACAAUUCGGUUGUGAACAU | 5604 | 2016 |
| AD-19751 | CCACGACUAGUUCAGUUGC | 4946 | GCAACUGAACUAGUCGUGG | 5605 | 1868 |
| AD-19752 | CACGACUAGUUCAGUUGCU | 4947 | AGCAACUGAACUAGUCGUG | 5606 | 1869 |
| AD-19753 | AGUUCAGUUGCUUGUUCGU | 4948 | ACGAACAAGCAACUGAACU | 5607 | 1876 |
| AD-19754 | CCCAGCGCCGUACGUCCAU | 4949 | AUGGACGUACGGCGCUGGG | 5608 | 1908 |
| AD-19755 | GAGUUACUUCACUCUAGGA | 4950 | UCCUAGAGUGAAGUAACUC | 5609 | 2192 |
| AD-19756 | ACAGUAUGCAAUGACUCGA | 4951 | UCGAGUCAUUGCAUACUGU | 5610 | 520 |
| AD-19757 | UAUGCAAUGACUCGAGCUC | 4952 | GAGCUCGAGUCAUUGCAUA | 5611 | 524 |
| AD-19758 | CCCACUAAUGUCCAGCGUU | 4953 | AACGCUGGACAUUAGUGGG | 5612 | 623 |
| AD-19759 | GACCUUGCAUAACCUUUCC | 4954 | GGAAAGGUUAUGCAAGGUC | 5613 | 916 |
| AD-19760 | UAUUACGACAGACUGCCUU | 4955 | AAGGCAGUCUGUCGUAAUA | 5614 | 1153 |
| AD-19761 | AUCUGACCAGCCGACACCA | 4956 | UGGUGUCGGCUGGUCAGAU | 5615 | 1677 |
| AD-19762 | CAUUCCACGACUAGUUCAG | 4957 | CUGAACUAGUCGUGGAAUG | 5616 | 1864 |
| AD-19763 | GUUUUGAAAAUCCAGCGUG | 4958 | CACGCUGGAUUUUCAAAAC | 5617 | 246 |
| AD-19765 | GCGUUUGGCUGAACCAUCA | 4959 | UGAUGGUUCAGCCAAACGC | 5618 | 637 |
| AD-19766 | ACACGCUAUCAUGCGUUCU | 4960 | AGAACGCAUGAUAGCGUGU | 5619 | 823 |
| AD-19767 | UAUGCCAUUACAACUCUCC | 4961 | GGAGAGUUGUAAUGGCAUA | 5620 | 1028 |
| AD-19768 | UCUGCUCUAGUAAUAAGCC | 4962 | GGCUUAUUACUAGAGCAGA | 5621 | 1314 |
| AD-20124 | CGGGAUGUUCACAACCGAA | 4963 | UUCGGUUGUGAACAUCCCG | 5622 | 2012 |
| AD-25889 | ACAAUACAAAUGGAUUUUG | 4964 | CAAAAUCCAUUUGUAUUGU | 5623 | 2632 |
| AD-25890 | ACAAAUGGAUUUUGGGAGU | 4965 | ACUCCCAAAAUCCAUUUGU | 5624 | 2637 |
| AD-25891 | UUGGGAGUGACUCAAGAAG | 4966 | CUUCUUGAGUCACUCCCAA | 5625 | 2648 |
| AD-25892 | UGGGAGUGACUCAAGAAGU | 4967 | ACUUCUUGAGUCACUCCCA | 5626 | 2649 |
| AD-25893 | GAAGUGAAGAAUGCACAAG | 4968 | CUUGUGCAUUCUUCACUUC | 5627 | 2663 |
| AD-25894 | AAGUGAAGAAUGCACAAGA | 4969 | UCUUGUGCAUUCUUCACUU | 5628 | 2664 |
| AD-25895 | GAUGGAAUUUAUCAAACCC | 4970 | GGGUUUGAUAAAUUCCAUC | 5629 | 2694 |
| AD-25896 | AUGGAAUUUAUCAAACCCU | 4971 | AGGGUUUGAUAAAUUCCAU | 5630 | 2695 |
| AD-25897 | GGAAUUUAUCAAACCCUAG | 4972 | CUAGGGUUUGAUAAAUUCC | 5631 | 2697 |
| AD-25898 | GAAUUUAUCAAACCCUAGC | 4973 | GCUAGGGUUUGAUAAAUUC | 5632 | 2698 |
| AD-25899 | AAUUUAUCAAACCCUAGCC | 4974 | GGCUAGGGUUUGAUAAAUU | 5633 | 2699 |
| AD-25900 | GAAUAUCUGUAAUGGUACU | 4975 | AGUACCAUUACAGAUAUUC | 5634 | 2751 |
| AD-25901 | AAUAUCUGUAAUGGUACUG | 4976 | CAGUACCAUUACAGAUAUU | 5635 | 2752 |
| AD-25902 | AUAUCUGUAAUGGUACUGA | 4977 | UCAGUACCAUUACAGAUAU | 5636 | 2753 |
| AD-25903 | UUUUAAGUCUCUCGUAGUG | 4978 | CACUACGAGAGACUUAAAA | 5637 | 2832 |
| AD-25904 | UUUAAGUCUCUCGUAGUGU | 4979 | ACACUACGAGAGACUUAAA | 5638 | 2833 |
| AD-25905 | AGUCUCUCGUAGUGUUAAG | 4980 | CUUAACACUACGAGAGACU | 5639 | 2837 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-25906 | UCGUAGUGUUAAGUUAUAG | 4981 | CUAUAACUUAACACUACGA | 5640 | 2843 |
| AD-25907 | CGUAGUGUUAAGUUAUAGU | 4982 | ACUAUAACUUAACACUACG | 5641 | 2844 |
| AD-25908 | GUAGUGUUAAGUUAUAGUG | 4983 | CACUAUAACUUAACACUAC | 5642 | 2845 |
| AD-25909 | UAGUGUUAAGUUAUAGUGA | 4984 | UCACUAUAACUUAACACUA | 5643 | 2846 |
| AD-25910 | UAGUGAAUACUGCUACAGC | 4985 | GCUGUAGCAGUAUUCACUA | 5644 | 2859 |
| AD-25911 | AACACUAAUUCAUAAUCAC | 4986 | GUGAUUAUGAAUUAGUGUU | 5645 | 2913 |
| AD-25912 | ACACUAAUUCAUAAUCACU | 4987 | AGUGAUUAUGAAUUAGUGU | 5646 | 2914 |
| AD-25913 | UAAUUGUAAUCUGAAUAAA | 4988 | UUUAUUCAGAUUACAAUUA | 5647 | 2938 |
| AD-25914 | AUUGUAAUCUGAAUAAAGU | 4989 | ACUUUAUUCAGAUUACAAU | 5648 | 2940 |
| AD-25915 | UUGUAAUCUGAAUAAAGUG | 4990 | CACUUUAUUCAGAUUACAA | 5649 | 2941 |
| AD-25916 | UGUAAUCUGAAUAAAGUGU | 4991 | ACACUUUAUUCAGAUUACA | 5650 | 2942 |
| AD-25917 | GACAAUAGAAAAUGGUCC | 4992 | GGACCAUUUUCUAUUUGUC | 5651 | 2991 |
| AD-25918 | ACAAUAGAAAAUGGUCCA | 4993 | UGGACCAUUUUCUAUUUGU | 5652 | 2992 |
| AD-25919 | UAGAAAAUGGUCCAAUUAG | 4994 | CUAAUUGGACCAUUUUCUA | 5653 | 2997 |
| AD-25920 | AGAAAAUGGUCCAAUUAGU | 4995 | ACUAAUUGGACCAUUUUCU | 5654 | 2998 |
| AD-25921 | UAUUGGGAUAUGUAUGGG | 4996 | CCCAUACAUAUCCCAAAUA | 5655 | 3077 |
| AD-25922 | AUUUGGGAUAUGUAUGGGU | 4997 | ACCCAUACAUAUCCCAAAU | 5656 | 3078 |
| AD-25923 | UUGGGAUAUGUAUGGGUAG | 4998 | CUACCCAUACAUAUCCCAA | 5657 | 3080 |
| AD-25924 | GGAUAUGUAUGGGUAGGGU | 4999 | ACCCUACCCAUACAUAUCC | 5658 | 3083 |
| AD-25925 | AAGAGGUGUUAUUUGGAAC | 5000 | GUUCCAAAUAACACCUCUU | 5659 | 3110 |
| AD-25926 | AGAGGUGUUAUUUGGAACC | 5001 | GGUUCCAAAUAACACCUCU | 5660 | 3111 |
| AD-25927 | GAGGUGUUAUUUGGAACCU | 5002 | AGGUUCCAAAUAACACCUC | 5661 | 3112 |
| AD-25928 | UGGAACCUUGUUUUGGACA | 5003 | UGUCCAAAACAAGGUUCCA | 5662 | 3123 |
| AD-25929 | GGAACCUUGUUUUGGACAG | 5004 | CUGUCCAAAACAAGGUUCC | 5663 | 3124 |
| AD-25930 | GAACCUUGUUUUGGACAGU | 5005 | ACUGUCCAAAACAAGGUUC | 5664 | 3125 |
| AD-25931 | GUUUUGGACAGUUUACCAG | 5006 | CUGGUAAACUGUCCAAAAC | 5665 | 3132 |
| AD-25932 | UUUUGGACAGUUUACCAGU | 5007 | ACUGGUAAACUGUCCAAAA | 5666 | 3133 |
| AD-25933 | UUGGACAGUUUACCAGUUG | 5008 | CAACUGGUAAACUGUCCAA | 5667 | 3135 |
| AD-25934 | GUUGUUGUAACCUGCUGUG | 5009 | CACAGCAGGUUACAACAAC | 5668 | 3168 |
| AD-25935 | UUGUUGUAACCUGCUGUGA | 5010 | UCACAGCAGGUUACAACAA | 5669 | 3169 |
| AD-25936 | UUGUAACCUGCUGUGAUAC | 5011 | GUAUCACAGCAGGUUACAA | 5670 | 3172 |
| AD-25937 | AUGCUUCAAGAGAAAUGC | 5012 | GCAUUUCUCUUGAAGCAU | 5671 | 3192 |
| AD-25938 | AGUGAAGAAUGCACAAGAA | 5013 | UUCUUGUGCAUUCUUCACU | 5672 | 2665 |
| AD-25939 | AAUGGAUCACAAGAUGGAA | 5014 | UUCCAUCUUGUGAUCCAUU | 5673 | 2682 |
| AD-25940 | AUGGAUCACAAGAUGGAAU | 5015 | AUUCCAUCUUGUGAUCCAU | 5674 | 2683 |
| AD-25941 | UGGAUCACAAGAUGGAAUU | 5016 | AAUUCCAUCUUGUGAUCCA | 5675 | 2684 |
| AD-25942 | GGAUCACAAGAUGGAAUUU | 5017 | AAAUUCCAUCUUGUGAUCC | 5676 | 2685 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-25943 | GAUCACAAGAUGGAAUUUA | 5018 | UAAAUUCCAUCUUGUGAUC | 5677 | 2686 |
| AD-25944 | AUCACAAGAUGGAAUUUAU | 5019 | AUAAAUUCCAUCUUGUGAU | 5678 | 2687 |
| AD-25945 | UGGAAUUUAUCAAACCCUA | 5020 | UAGGGUUUGAUAAAUUCCA | 5679 | 2696 |
| AD-25946 | ACCCUAGCCUUGCUUGUUA | 5021 | UAACAAGCAAGGCUAGGGU | 5680 | 2709 |
| AD-25947 | CCCUAGCCUUGCUUGUUAA | 5022 | UUACAAGCAAGGCUAGGG | 5681 | 2710 |
| AD-25948 | CCUAGCCUUGCUUGUUAAA | 5023 | UUUACAAGCAAGGCUAGG | 5682 | 2711 |
| AD-25949 | CUAGCCUUGCUUGUUAAAU | 5024 | AUUUAACAAGCAAGGCUAG | 5683 | 2712 |
| AD-25950 | UAGCCUUGCUUGUUAAAUU | 5025 | AAUUUAACAAGCAAGGCUA | 5684 | 2713 |
| AD-25951 | AGCCUUGCUUGUUAAAUUU | 5026 | AAAUUUAACAAGCAAGGCU | 5685 | 2714 |
| AD-25952 | UUAAGUCUCUCGUAGUGUU | 5027 | AACACUACGAGAGACUUAA | 5686 | 2834 |
| AD-25953 | UAAGUCUCUCGUAGUGUUA | 5028 | UAACACUACGAGAGACUUA | 5687 | 2835 |
| AD-25954 | AAGUCUCUCGUAGUGUUAA | 5029 | UUAACACUACGAGAGACUU | 5688 | 2836 |
| AD-25955 | CUCGUAGUGUUAAGUUAUA | 5030 | UAUAACUUAACACUACGAG | 5689 | 2842 |
| AD-25956 | AGUGUUAAGUUAUAGUGAA | 5031 | UUCACUAUAACUUAACACU | 5690 | 2847 |
| AD-25957 | GUGUUAAGUUAUAGUGAAU | 5032 | AUUCACUAUAACUUAACAC | 5691 | 2848 |
| AD-25958 | CUACAGCAAUUUCUAAUUU | 5033 | AAAUUAGAAAUUGCUGUAG | 5692 | 2871 |
| AD-25959 | CAAAUAGAAAAUGGUCCAA | 5034 | UUGGACCAUUUUCUAUUUG | 5693 | 2993 |
| AD-25960 | AUAGAAAAUGGUCCAAUUA | 5035 | UAAUUGGACCAUUUUCUAU | 5694 | 2996 |
| AD-25961 | UUUGGGAUAUGUAUGGGUA | 5036 | UACCCAUACAUAUCCCAAA | 5695 | 3079 |
| AD-25962 | GAUAUGUAUGGGUAGGGUA | 5037 | UACCCUACCCAUACAUAUC | 5696 | 3084 |
| AD-25963 | UGGGUAGGGUAAAUCAGUA | 5038 | UACUGAUUUACCCUACCCA | 5697 | 3092 |
| AD-25964 | UAAGAGGUGUUAUUUGGAA | 5039 | UUCCAAAUAACACCUCUUA | 5698 | 3109 |
| AD-26017 | UGCCUUUUAUCCCAAAGUU | 5040 | AACUUUGGGAUAAAAGGCA | 5699 | 3152 |
| AD-26018 | UGUUGUAACCUGCUGUGAU | 5041 | AUCACAGCAGGUUACAACA | 5700 | 3170 |
| AD-26019 | GUUGUAACCUGCUGUGAUA | 5042 | UAUCACAGCAGGUUACAAC | 5701 | 3171 |
| AD-26020 | CAAGAGAAAAUGCGGUUAU | 5043 | AUAACCGCAUUUUCUCUUG | 5702 | 3198 |
| AD-26021 | AAGAGAAAAUGCGGUUAUA | 5044 | UAUAACCGCAUUUUCUCUU | 5703 | 3199 |
| AD-26022 | CCUGUUCCCUGAGGGUAU | 5045 | AUACCCUCAGGGGAACAGG | 5704 | 207 |
| AD-26023 | CUGUUCCCUGAGGGUAUU | 5046 | AAUACCCUCAGGGGAACAG | 5705 | 208 |
| AD-26024 | CCUGAGGGUAUUUGAAGUA | 5047 | UACUUCAAAUACCCUCAGG | 5706 | 215 |
| AD-26025 | CUGAGGGUAUUUGAAGUAU | 5048 | AUACUUCAAAUACCCUCAG | 5707 | 216 |
| AD-26026 | UGAGGGUAUUUGAAGUAUA | 5049 | UAUACUUCAAAUACCCUCA | 5708 | 217 |
| AD-26027 | GGUAUUUGAAGUAUACCAU | 5050 | AUGGUAUACUUCAAAUACC | 5709 | 221 |
| AD-26028 | GUAUUUGAAGUAUACCAUA | 5051 | UAUGGUAUACUUCAAAUAC | 5710 | 222 |
| AD-26029 | UUUGAAGUAUACCAUACAA | 5052 | UUGUAUGGUAUACUUCAAA | 5711 | 225 |
| AD-26030 | AGUAUACCAUACAACUGUU | 5053 | AACAGUUGUAUGGUAUACU | 5712 | 230 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26031 | GUAUACCAUACAACUGUUU | 5054 | AAACAGUUGUAUGGUAUAC | 5713 | 231 |
| AD-26032 | UAUACCAUACAACUGUUUU | 5055 | AAAACAGUUGUAUGGUAUA | 5714 | 232 |
| AD-26033 | ACCAUACAACUGUUUUGAA | 5056 | UUCAAAACAGUUGUAUGGU | 5715 | 235 |
| AD-26034 | CCAUACAACUGUUUUGAAA | 5057 | UUUCAAAACAGUUGUAUGG | 5716 | 236 |
| AD-26035 | GAAAAUCCAGCGUGGACAA | 5058 | UUGUCCACGCUGGAUUUUC | 5717 | 251 |
| AD-26036 | AAAAUCCAGCGUGGACAAU | 5059 | AUUGUCCACGCUGGAUUUU | 5718 | 252 |
| AD-26037 | CCAGCGUGGACAAUGGCUA | 5060 | UAGCCAUUGUCCACGCUGG | 5719 | 257 |
| AD-26038 | GUGGACAAUGGCUACUCAA | 5061 | UUGAGUAGCCAUUGUCCAC | 5720 | 262 |
| AD-26039 | AAUGGCUACUCAAGCUGAU | 5062 | AUCAGCUUGAGUAGCCAUU | 5721 | 268 |
| AD-26040 | AUGGCUACUCAAGCUGAUU | 5063 | AAUCAGCUUGAGUAGCCAU | 5722 | 269 |
| AD-26041 | UGGCUACUCAAGCUGAUUU | 5064 | AAAUCAGCUUGAGUAGCCA | 5723 | 270 |
| AD-26042 | CUACUCAAGCUGAUUUGAU | 5065 | AUCAAAUCAGCUUGAGUAG | 5724 | 273 |
| AD-26043 | AUUUGAUGGAGUUGGACAU | 5066 | AUGUCCAACUCCAUCAAAU | 5725 | 285 |
| AD-26044 | UGGAGUUGGACAUGGCCAU | 5067 | AUGGCCAUGUCCAACUCCA | 5726 | 291 |
| AD-26045 | GUUGGACAUGGCCAUGGAA | 5068 | UUCCAUGGCCAUGUCCAAC | 5727 | 295 |
| AD-26046 | GCCAUGGAACCAGACAGAA | 5069 | UUCUGUCUGGUUCCAUGGC | 5728 | 305 |
| AD-26047 | CAUGGAACCAGACAGAAAA | 5070 | UUUUCUGUCUGGUUCCAUG | 5729 | 307 |
| AD-26048 | GGAGGCGGAGACGGAGGAA | 5071 | UUCCUCCGUCUCCGCCUCC | 5730 | 111 |
| AD-26049 | AGACAGAAAAGCGGCUGUU | 5072 | AACAGCCGCUUUUCUGUCU | 5731 | 316 |
| AD-26050 | GACAGAAAAGCGGCUGUUA | 5073 | UAACAGCCGCUUUUCUGUC | 5732 | 317 |
| AD-26051 | UGUUAGUCACUGGCAGCAA | 5074 | UUGCUGCCAGUGACUAACA | 5733 | 331 |
| AD-26052 | CACUGGCAGCAACAGUCUU | 5075 | AAGACUGUUGCUGCCAGUG | 5734 | 338 |
| AD-26053 | ACUGGCAGCAACAGUCUUA | 5076 | UAAGACUGUUGCUGCCAGU | 5735 | 339 |
| AD-26054 | UCUUACCUGGACUCUGGAA | 5077 | UUCCAGAGUCCAGGUAAGA | 5736 | 353 |
| AD-26055 | CUUACCUGGACUCUGGAAU | 5078 | AUUCCAGAGUCCAGGUAAG | 5737 | 354 |
| AD-26056 | CCUGGACUCUGGAAUCCAU | 5079 | AUGGAUUCCAGAGUCCAGG | 5738 | 358 |
| AD-26057 | GGCUAGUGGUGGACCCCAA | 5080 | UUGGGGUCCACCACUAGCC | 5739 | 1216 |
| AD-26058 | GCCACUACCACAGCUCCUU | 5081 | AAGGAGCUGUGGUAGUGGC | 5740 | 383 |
| AD-26059 | UCCUUCUCUGAGUGGUAAA | 5082 | UUUACCACUCAGAGAAGGA | 5741 | 397 |
| AD-26060 | CUCUGAGUGGUAAAGGCAA | 5083 | UUGCCUUUACCACUCAGAG | 5742 | 402 |
| AD-26061 | UAAAGGCAAUCCUGAGGAA | 5084 | UUCCUCAGGAUUGCCUUUA | 5743 | 412 |
| AD-26062 | CAAUCCUGAGGAAGAGGAU | 5085 | AUCCUCUUCCUCAGGAUUG | 5744 | 418 |
| AD-26063 | UGAGGAAGAGGAUGUGGAU | 5086 | AUCCACAUCCUCUUCCUCA | 5745 | 424 |
| AD-26064 | AUACCUCCCAAGUCCUGUA | 5087 | UACAGGACUUGGGAGGUAU | 5746 | 441 |
| AD-26065 | UACCUCCCAAGUCCUGUAU | 5088 | AUACAGGACUUGGGAGGUA | 5747 | 442 |
| AD-26066 | AGUCCUGUAUGAGUGGGAA | 5089 | UUCCCACUCAUACAGGACU | 5748 | 451 |
| AD-26067 | UAUGAGUGGGAACAGGGAU | 5090 | AUCCCUGUUCCCACUCAUA | 5749 | 458 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26068 | CAAGCUUUAGUAAAUAUAA | 5091 | UUAUAUUUACUAAAGCUUG | 5750 | 1232 |
| AD-26069 | AAGCUUUAGUAAAUAUAAU | 5092 | AUUAUAUUUACUAAAGCUU | 5751 | 1233 |
| AD-26070 | UGAGUGGGAACAGGGAUUU | 5093 | AAAUCCCUGUUCCCACUCA | 5752 | 460 |
| AD-26071 | GAGUGGGAACAGGGAUUUU | 5094 | AAAAUCCCUGUUCCCACUC | 5753 | 461 |
| AD-26072 | AGGGAUUUUCUCAGUCCUU | 5095 | AAGGACUGAGAAAAUCCCU | 5754 | 471 |
| AD-26073 | UUCUCAGUCCUUCACUCAA | 5096 | UUGAGUGAAGGACUGAGAA | 5755 | 478 |
| AD-26074 | UCAGUCCUUCACUCAAGAA | 5097 | UUCUUGAGUGAAGGACUGA | 5756 | 481 |
| AD-26075 | CUUCACUCAAGAACAAGUA | 5098 | UACUUGUUCUUGAGUGAAG | 5757 | 487 |
| AD-26076 | UCAAGAACAAGUAGCUGAU | 5099 | AUCAGCUACUUGUUCUUGA | 5758 | 493 |
| AD-26077 | CUGAUAUUGAUGGACAGUA | 5100 | UACUGUCCAUCAAUAUCAG | 5759 | 507 |
| AD-26078 | AUUGAUGGACAGUAUGCAA | 5101 | UUGCAUACUGUCCAUCAAU | 5760 | 512 |
| AD-26079 | GACUCGAGCUCAGAGGGUA | 5102 | UACCCUCUGAGCUCGAGUC | 5761 | 532 |
| AD-26080 | CAGAGGGUACGAGCUGCUA | 5103 | UAGCAGCUCGUACCCUCUG | 5762 | 542 |
| AD-26081 | AGAGGGUACGAGCUGCUAU | 5104 | AUAGCAGCUCGUACCCUCU | 5763 | 543 |
| AD-26082 | GGGUACGAGCUGCUAUGUU | 5105 | AACAUAGCAGCUCGUACCC | 5764 | 546 |
| AD-26083 | CUAUGUUCCCUGAGACAUU | 5106 | AAUGUCUCAGGGAACAUAG | 5765 | 558 |
| AD-26084 | UAUGUUCCCUGAGACAUUA | 5107 | UAAUGUCUCAGGGAACAUA | 5766 | 559 |
| AD-26085 | GUUCCCUGAGACAUUAGAU | 5108 | AUCUAAUGUCUCAGGGAAC | 5767 | 562 |
| AD-26086 | UAGAUGAGGGCAUGCAGAU | 5109 | AUCUGCAUGCCCUCAUCUA | 5768 | 576 |
| AD-26087 | GAGGGCAUGCAGAUCCCAU | 5110 | AUGGGAUCUGCAUGCCCUC | 5769 | 581 |
| AD-26088 | GGCAUGCAGAUCCCAUCUA | 5111 | UAGAUGGGAUCUGCAUGCC | 5770 | 584 |
| AD-26089 | AGAUCCCAUCUACACAGUU | 5112 | AACUGUGUAGAUGGGAUCU | 5771 | 591 |
| AD-26090 | CCCAUCUACACAGUUUGAU | 5113 | AUCAAACUGUGUAGAUGGG | 5772 | 595 |
| AD-26091 | ACAGUUUGAUGCUGCUCAU | 5114 | AUGAGCAGCAUCAAACUGU | 5773 | 604 |
| AD-26092 | GAUGCUGCUCAUCCCACUA | 5115 | UAGUGGGAUGAGCAGCAUC | 5774 | 611 |
| AD-26093 | AUGCUGCUCAUCCCACUAA | 5116 | UUAGUGGGAUGAGCAGCAU | 5775 | 612 |
| AD-26094 | UGCUGCUCAUCCCACUAAU | 5117 | AUUAGUGGGAUGAGCAGCA | 5776 | 613 |
| AD-26095 | CCCACUAAUGUCCAGCGUU | 5118 | AACGCUGGACAUUAGUGGG | 5777 | 623 |
| AD-26096 | CAGCGUUUGGCUGAACCAU | 5119 | AUGGUUCAGCCAAACGCUG | 5778 | 635 |
| AD-26097 | UGGCUGAACCAUCACAGAU | 5120 | AUCUGUGAUGGUUCAGCCA | 5779 | 642 |
| AD-26098 | AACCAUCACAGAUGCUGAA | 5121 | UUCAGCAUCUGUGAUGGUU | 5780 | 648 |
| AD-26099 | ACCAUCACAGAUGCUGAAA | 5122 | UUUCAGCAUCUGUGAUGGU | 5781 | 649 |
| AD-26100 | AUCACAGAUGCUGAAACAU | 5123 | AUGUUUCAGCAUCUGUGAU | 5782 | 652 |
| AD-26101 | GAUGCUGAAACAUGCAGUU | 5124 | AACUGCAUGUUUCAGCAUC | 5783 | 658 |
| AD-26102 | CUGAAACAUGCAGUUGUAA | 5125 | UUACAACUGCAUGUUUCAG | 5784 | 662 |
| AD-26103 | AACAUGCAGUUGUAAACUU | 5126 | AAGUUUACAACUGCAUGUU | 5785 | 666 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26104 | AUGCAGUUGUAAACUUGAU | 5127 | AUCAAGUUUACAACUGCAU | 5786 | 669 |
| AD-26105 | UGCAGUUGUAAACUUGAUU | 5128 | AAUCAAGUUUACAACUGCA | 5787 | 670 |
| AD-26106 | CAGUUGUAAACUUGAUUAA | 5129 | UUAAUCAAGUUUACAACUG | 5788 | 672 |
| AD-26107 | CUUGAUUAACUAUCAAGAU | 5130 | AUCUUGAUAGUUAAUCAAG | 5789 | 682 |
| AD-26108 | GAUUAACUAUCAAGAUGAU | 5131 | AUCAUCUUGAUAGUUAAUC | 5790 | 685 |
| AD-26109 | CUAUCAAGAUGAUGCAGAA | 5132 | UUCUGCAUCAUCUUGAUAG | 5791 | 691 |
| AD-26110 | GAACUUGCCACACGUGCAA | 5133 | UUGCACGUGUGGCAAGUUC | 5792 | 707 |
| AD-26111 | AACUUGCCACACGUGCAAU | 5134 | AUUGCACGUGUGGCAAGUU | 5793 | 708 |
| AD-26112 | CACACGUGCAAUCCCUGAA | 5135 | UUCAGGGAUUGCACGUGUG | 5794 | 715 |
| AD-26123 | GCAAUCCCUGAACUGACAA | 5136 | UUGUCAGUUCAGGGAUUGC | 5795 | 722 |
| AD-26124 | CAAUCCCUGAACUGACAAA | 5137 | UUUGUCAGUUCAGGGAUUG | 5796 | 723 |
| AD-26125 | AAUCCCUGAACUGACAAAA | 5138 | UUUUGUCAGUUCAGGGAUU | 5797 | 724 |
| AD-26126 | UGAACUGACAAAACUGCUA | 5139 | UAGCAGUUUUGUCAGUUCA | 5798 | 730 |
| AD-26127 | GAACUGACAAAACUGCUAA | 5140 | UUAGCAGUUUUGUCAGUUC | 5799 | 731 |
| AD-26128 | AACUGACAAAACUGCUAAA | 5141 | UUUAGCAGUUUUGUCAGUU | 5800 | 732 |
| AD-26129 | ACUGACAAAACUGCUAAAU | 5142 | AUUUAGCAGUUUUGUCAGU | 5801 | 733 |
| AD-26130 | GAGGACCAGGUGGUGGUUA | 5143 | UAACCACCACCUGGUCCUC | 5802 | 755 |
| AD-26131 | AGGACCAGGUGGUGGUUAA | 5144 | UUAACCACCACCUGGUCCU | 5803 | 756 |
| AD-26132 | GGACCAGGUGGUGGUUAAU | 5145 | AUUAACCACCACCUGGUCC | 5804 | 757 |
| AD-26133 | GACCAGGUGGUGGUUAAUA | 5146 | UAUUAACCACCACCUGGUC | 5805 | 758 |
| AD-26134 | UCACUUGCAAUAAUUAUAA | 5147 | UUAUAAUUAUUGCAAGUGA | 5806 | 1548 |
| AD-26135 | CUUGCAAUAAUUAUAAGAA | 5148 | UUCUUAUAAUUAUUGCAAG | 5807 | 1551 |
| AD-26136 | ACCAGGUGGUGGUUAAUAA | 5149 | UUAUUAACCACCACCUGGU | 5808 | 759 |
| AD-26137 | GGCUGCAGUUAUGGUCCAU | 5150 | AUGGACCAUAACUGCAGCC | 5809 | 778 |
| AD-26138 | GUUAUGGUCCAUCAGCUUU | 5151 | AAAGCUGAUGGACCAUAAC | 5810 | 785 |
| AD-26139 | AUGGUCCAUCAGCUUUCUA | 5152 | UAGAAAGCUGAUGGACCAU | 5811 | 788 |
| AD-26140 | UGGUCCAUCAGCUUUCUAA | 5153 | UUAGAAAGCUGAUGGACCA | 5812 | 789 |
| AD-26141 | UCGGGCUGGUGACAGGGAA | 5154 | UUCCCUGUCACCAGCCCGA | 5813 | 1624 |
| AD-26142 | GGUCCAUCAGCUUUCUAAA | 5155 | UUUAGAAAGCUGAUGGACC | 5814 | 790 |
| AD-26143 | GUCCAUCAGCUUUCUAAAA | 5156 | UUUUAGAAAGCUGAUGGAC | 5815 | 791 |
| AD-26144 | GAAGCUUCCAGACACGCUA | 5157 | UAGCGUGUCUGGAAGCUUC | 5816 | 812 |
| AD-26145 | AAGCUUCCAGACACGCUAU | 5158 | AUAGCGUGUCUGGAAGCUU | 5817 | 813 |
| AD-26146 | CUUCCAGACACGCUAUCAU | 5159 | AUGAUAGCGUGUCUGGAAG | 5818 | 816 |
| AD-26147 | AGACACGCUAUCAUGCGUU | 5160 | AACGCAUGAUAGCGUGUCU | 5819 | 821 |
| AD-26148 | UCAUGCGUUCUCCUCAGAU | 5161 | AUCUGAGGAGAACGCAUGA | 5820 | 831 |
| AD-26149 | CCUCAGAUGGUGUCUGCUA | 5162 | UAGCAGACACCAUCUGAGG | 5821 | 842 |
| AD-26150 | CUCAGAUGGUGUCUGCUAU | 5163 | AUAGCAGACACCAUCUGAG | 5822 | 843 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26151 | GUGUCUGCUAUUGUACGUA | 5164 | UACGUACAAUAGCAGACAC | 5823 | 851 |
| AD-26152 | CUGCUAUUGUACGUACCAU | 5165 | AUGGUACGUACAAUAGCAG | 5824 | 855 |
| AD-26153 | UUGUACGUACCAUGCAGAA | 5166 | UUCUGCAUGGUACGUACAA | 5825 | 861 |
| AD-26154 | UGUACGUACCAUGCAGAAU | 5167 | AUUCUGCAUGGUACGUACA | 5826 | 862 |
| AD-26155 | CGUACCAUGCAGAAUACAA | 5168 | UUGUAUUCUGCAUGGUACG | 5827 | 866 |
| AD-26156 | CAUGCAGAAUACAAAUGAU | 5169 | AUCAUUUGUAUUCUGCAUG | 5828 | 871 |
| AD-26157 | GCAGAAUACAAAUGAUGUA | 5170 | UACAUCAUUUGUAUUCUGC | 5829 | 874 |
| AD-26158 | GAAUACAAAUGAUGUAGAA | 5171 | UUCUACAUCAUUUGUAUUC | 5830 | 877 |
| AD-26159 | GAUGUAGAAACAGCUCGUU | 5172 | AACGAGCUGUUUCUACAUC | 5831 | 887 |
| AD-26160 | GUUGUACCGCUGGGACCUU | 5173 | AAGGUCCCAGCGGUACAAC | 5832 | 903 |
| AD-26161 | UACCGCUGGGACCUUGCAU | 5174 | AUGCAAGGUCCCAGCGGUA | 5833 | 907 |
| AD-26162 | CCGCUGGGACCUUGCAUAA | 5175 | UUAUGCAAGGUCCCAGCGG | 5834 | 909 |
| AD-26163 | UGGGACCUUGCAUAACCUU | 5176 | AAGGUUAUGCAAGGUCCCA | 5835 | 913 |
| AD-26164 | GGGACCUUGCAUAACCUUU | 5177 | AAAGGUUAUGCAAGGUCCC | 5836 | 914 |
| AD-26165 | CUUGCAUAACCUUUCCCAU | 5178 | AUGGGAAAGGUUAUGCAAG | 5837 | 919 |
| AD-26166 | UCUUAAGUCUGGAGGCAU | 5179 | AUGCCUCCAGACUUAAAGA | 5838 | 960 |
| AD-26167 | GCAUUCCUGCCCUGGUGAA | 5180 | UUCACCAGGGCAGGAAUGC | 5839 | 975 |
| AD-26168 | CAUUCCUGCCCUGGUGAAA | 5181 | UUUCACCAGGGCAGGAAUG | 5840 | 976 |
| AD-26169 | AUUCCUGCCCUGGUGAAAA | 5182 | UUUUCACCAGGGCAGGAAU | 5841 | 977 |
| AD-26170 | UUCCUGCCCUGGUGAAAAU | 5183 | AUUUUCACCAGGGCAGGAA | 5842 | 978 |
| AD-26171 | UGCCCUGGUGAAAAUGCUU | 5184 | AAGCAUUUUCACCAGGGCA | 5843 | 982 |
| AD-26172 | CUGGUGAAAAUGCUUGGUU | 5185 | AACCAAGCAUUUUCACCAG | 5844 | 986 |
| AD-26173 | GCUUGGUUCACCAGUGGAU | 5186 | AUCCACUGGUGAACCAAGC | 5845 | 997 |
| AD-26174 | CUUGGUUCACCAGUGGAUU | 5187 | AAUCCACUGGUGAACCAAG | 5846 | 998 |
| AD-26175 | UGCGUGAGCAGGGUGCCAU | 5188 | AUGGCACCCUGCUCACGCA | 5847 | 1848 |
| AD-26176 | GCGUGAGCAGGGUGCCAUU | 5189 | AAUGGCACCCUGCUCACGC | 5848 | 1849 |
| AD-26177 | CACCAGUGGAUUCUGUGUU | 5190 | AACACAGAAUCCACUGGUG | 5849 | 1005 |
| AD-26178 | CAGUGGAUUCUGUGUUGUU | 5191 | AACAACACAGAAUCCACUG | 5850 | 1008 |
| AD-26179 | AGUGGAUUCUGUGUUGUUU | 5192 | AAACAACACAGAAUCCACU | 5851 | 1009 |
| AD-26180 | GUGGAUUCUGUGUUGUUUU | 5193 | AAAACAACACAGAAUCCAC | 5852 | 1010 |
| AD-26181 | UGGAUUCUGUGUUGUUUUA | 5194 | UAAAACAACACAGAAUCCA | 5853 | 1011 |
| AD-26182 | GGAUUCUGUGUUGUUUUAU | 5195 | AUAAAACAACACAGAAUCC | 5854 | 1012 |
| AD-26183 | UGUGUUGUUUUAUGCCAUU | 5196 | AAUGGCAUAAAACAACACA | 5855 | 1018 |
| AD-26184 | GGGUGGGACACAGCAGCAA | 5197 | UUGCUGCUGUGUCCCACCC | 5856 | 1927 |
| AD-26185 | GUGUUGUUUUAUGCCAUUA | 5198 | UAAUGGCAUAAAACAACAC | 5857 | 1019 |
| AD-26186 | UUGUUUUAUGCCAUUACAA | 5199 | UUGUAAUGGCAUAAAACAA | 5858 | 1022 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26187 | CCAUUACAACUCUCCACAA | 5200 | UUGUGGAGAGUUGUAAUGG | 5859 | 1032 |
| AD-26188 | UACAACUCUCCACAACCUU | 5201 | AAGGUUGUGGAGAGUUGUA | 5860 | 1036 |
| AD-26189 | ACAACUCUCCACAACCUUU | 5202 | AAAGGUUGUGGAGAGUUGU | 5861 | 1037 |
| AD-26190 | CAACUCUCCACAACCUUUU | 5203 | AAAAGGUUGUGGAGAGUUG | 5862 | 1038 |
| AD-26191 | AACUCUCCACAACCUUUUA | 5204 | UAAAAGGUUGUGGAGAGUU | 5863 | 1039 |
| AD-26192 | ACUCUCCACAACCUUUUAU | 5205 | AUAAAAGGUUGUGGAGAGU | 5864 | 1040 |
| AD-26193 | CUCUCCACAACCUUUUAUU | 5206 | AAUAAAAGGUUGUGGAGAG | 5865 | 1041 |
| AD-26194 | UCUCCACAACCUUUUAUUA | 5207 | UAAUAAAAGGUUGUGGAGA | 5866 | 1042 |
| AD-26195 | CAACCUUUUAUUACAUCAA | 5208 | UUGAUGUAAUAAAAGGUUG | 5867 | 1048 |
| AD-26196 | CCUUUUAUUACAUCAAGAA | 5209 | UUCUUGAUGUAAUAAAAGG | 5868 | 1051 |
| AD-26197 | UUACAUCAAGAAGGAGCUA | 5210 | UAGCUCCUUCUUGAUGUAA | 5869 | 1058 |
| AD-26198 | UACAUCAAGAAGGAGCUAA | 5211 | UUAGCUCCUUCUUGAUGUA | 5870 | 1059 |
| AD-26199 | CAUCAAGAAGGAGCUAAAA | 5212 | UUUUAGCUCCUUCUUGAUG | 5871 | 1061 |
| AD-26200 | AUCAAGAAGGAGCUAAAAU | 5213 | AUUUUAGCUCCUUCUUGAU | 5872 | 1062 |
| AD-26201 | GCUAAAAUGGCAGUGCGUU | 5214 | AACGCACUGCCAUUUUAGC | 5873 | 1073 |
| AD-26202 | UAAAAUGGCAGUGCGUUUA | 5215 | UAAACGCACUGCCAUUUUA | 5874 | 1075 |
| AD-26203 | AAAUGGUUGCCUUGCUCAA | 5216 | UUGAGCAAGGCAACCAUUU | 5875 | 1110 |
| AD-26204 | GCCUGUUCCCUGAGGGUA | 5217 | UACCCUCAGGGGAACAGGC | 5876 | 206 |
| AD-26205 | UGGUUGCCUUGCUCAACAA | 5218 | UUGUUGAGCAAGGCAACCA | 5877 | 1113 |
| AD-26206 | GGUUGCCUUGCUCAACAAA | 5219 | UUUGUUGAGCAAGGCAACC | 5878 | 1114 |
| AD-26207 | GUUGCCUUGCUCAACAAAA | 5220 | UUUUGUUGAGCAAGGCAAC | 5879 | 1115 |
| AD-26208 | GCCUUGCUCAACAAAACAA | 5221 | UUGUUUUGUUGAGCAAGGC | 5880 | 1118 |
| AD-26209 | CCUUGCUCAACAAAACAAA | 5222 | UUUGUUUUGUUGAGCAAGG | 5881 | 1119 |
| AD-26210 | GUUAAAUUCUUGGCUAUUA | 5223 | UAAUAGCCAAGAAUUUAAC | 5882 | 1139 |
| AD-26211 | UAUUACGACAGACUGCCUU | 5224 | AAGGCAGUCUGUCGUAAUA | 5883 | 1153 |
| AD-26212 | AUGGCAACCAAGAAAGCAA | 5225 | UUGCUUUCUUGGUUGCCAU | 5884 | 1185 |
| AD-26213 | AGUGGUGGACCCCAAGCUU | 5226 | AAGCUUGGGGUCCACCACU | 5885 | 1220 |
| AD-26214 | GUGGUGGACCCCAAGCUUU | 5227 | AAAGCUUGGGGUCCACCAC | 5886 | 1221 |
| AD-26215 | UGGUGGACCCCAAGCUUUA | 5228 | UAAAGCUUGGGGUCCACCA | 5887 | 1222 |
| AD-26216 | UGGACCCCAAGCUUUAGUA | 5229 | UACUAAAGCUUGGGGUCCA | 5888 | 1225 |
| AD-26217 | GGACCCCAAGCUUUAGUAA | 5230 | UUACUAAAGCUUGGGGUCC | 5889 | 1226 |
| AD-26218 | GACCCCAAGCUUUAGUAAA | 5231 | UUUACUAAAGCUUGGGGUC | 5890 | 1227 |
| AD-26651 | ACCCCAAGCUUUAGUAAAU | 5232 | AUUUACUAAAGCUUGGGGU | 5891 | 1228 |
| AD-26652 | CCCCAAGCUUUAGUAAAUA | 5233 | UAUUUACUAAAGCUUGGGG | 5892 | 1229 |
| AD-26653 | CCCAAGCUUUAGUAAAUAU | 5234 | AUAUUUACUAAAGCUUGGG | 5893 | 1230 |
| AD-26654 | CCAAGCUUUAGUAAAUAUA | 5235 | UAUAUUUACUAAAGCUUGG | 5894 | 1231 |
| AD-26655 | UAAAUAUAAUGAGGACCUA | 5236 | UAGGUCCUCAUUAUAUUUA | 5895 | 1242 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26656 | AAAUAUAAUGAGGACCUAU | 5237 | AUAGGUCCUCAUUAUAUUU | 5896 | 1243 |
| AD-26657 | AAUAUAAUGAGGACCUAUA | 5238 | UAUAGGUCCUCAUUAUAUU | 5897 | 1244 |
| AD-26658 | AUAAUGAGGACCUAUACUU | 5239 | AAGUAUAGGUCCUCAUUAU | 5898 | 1247 |
| AD-26659 | AAACUACUGUGGACCACAA | 5240 | UUGUGGUCCACAGUAGUUU | 5899 | 1271 |
| AD-26660 | CCACAAGCAGAGUGCUGAA | 5241 | UUCAGCACUCUGCUUGUGG | 5900 | 1284 |
| AD-26661 | CAGAGUGCUGAAGGUGCUA | 5242 | UAGCACCUUCAGCACUCUG | 5901 | 1291 |
| AD-26662 | AGAGUGCUGAAGGUGCUAU | 5243 | AUAGCACCUUCAGCACUCU | 5902 | 1292 |
| AD-26663 | AUUGUAGAAGCUGGUGGAA | 5244 | UUCCACCAGCUUCUACAAU | 5903 | 1337 |
| AD-26664 | UUGUAGAAGCUGGUGGAAU | 5245 | AUUCCACCAGCUUCUACAA | 5904 | 1338 |
| AD-26665 | GCUGGUGGAAUGCAAGCUU | 5246 | AAGCUUGCAUUCCACCAGC | 5905 | 1346 |
| AD-26666 | CUGGUGGAAUGCAAGCUUU | 5247 | AAAGCUUGCAUUCCACCAG | 5906 | 1347 |
| AD-26667 | AGGACUUCACCUGACAGAU | 5248 | AUCUGUCAGGUGAAGUCCU | 5907 | 1366 |
| AD-26668 | CUUCACCUGACAGAUCCAA | 5249 | UUGGAUCUGUCAGGUGAAG | 5908 | 1370 |
| AD-26669 | CCUGACAGAUCCAAGUCAA | 5250 | UUGACUUGGAUCUGUCAGG | 5909 | 1375 |
| AD-26670 | AGAUCCAAGUCAACGUCUU | 5251 | AAGACGUUGACUUGGAUCU | 5910 | 1381 |
| AD-26671 | UCCAAGUCAACGUCUUGUU | 5252 | AACAAGACGUUGACUUGGA | 5911 | 1384 |
| AD-26672 | UCUUGUUCAGAACUGUCUU | 5253 | AAGACAGUUCUGAACAAGA | 5912 | 1396 |
| AD-26673 | CUUGUUCAGAACUGUCUUU | 5254 | AAAGACAGUUCUGAACAAG | 5913 | 1397 |
| AD-26674 | GUCUUUGGACUCUCAGGAA | 5255 | UUCCUGAGAGUCCAAAGAC | 5914 | 1410 |
| AD-26675 | UCUUUGGACUCUCAGGAAU | 5256 | AUUCCUGAGAGUCCAAAGA | 5915 | 1411 |
| AD-26676 | UUGGACUCUCAGGAAUCUU | 5257 | AAGAUUCCUGAGAGUCCAA | 5916 | 1414 |
| AD-26677 | UGCCCAGGGAGAACCCCUU | 5258 | AAGGGGUUCUCCCUGGGCA | 5917 | 2371 |
| AD-26678 | UGGACUCUCAGGAAUCUUU | 5259 | AAAGAUUCCUGAGAGUCCA | 5918 | 1415 |
| AD-26679 | UCUCAGGAAUCUUUCAGAU | 5260 | AUCUGAAAGAUUCCUGAGA | 5919 | 1420 |
| AD-26680 | AAUCUUUCAGAUGCUGCAA | 5261 | UUGCAGCAUCUGAAAGAUU | 5920 | 1427 |
| AD-26681 | CUUUCAGAUGCUGCAACUA | 5262 | UAGUUGCAGCAUCUGAAAG | 5921 | 1430 |
| AD-26682 | UUCAGAUGCUGCAACUAAA | 5263 | UUUAGUUGCAGCAUCUGAA | 5922 | 1432 |
| AD-26683 | UGCUGCAACUAAACAGGAA | 5264 | UUCCUGUUUAGUUGCAGCA | 5923 | 1438 |
| AD-26684 | UAAACAGGAAGGGAUGGAA | 5265 | UUCCAUCCCUUCCUGUUUA | 5924 | 1447 |
| AD-26685 | AGGGAUGGAAGGUCUCCUU | 5266 | AAGGAGACCUUCCAUCCCU | 5925 | 1456 |
| AD-26686 | AGGUCUCCUUGGGACUCUU | 5267 | AAGAGUCCCAAGGAGACCU | 5926 | 1465 |
| AD-26687 | UCUCCUUGGGACUCUUGUU | 5268 | AACAAGAGUCCCAAGGAGA | 5927 | 1468 |
| AD-26688 | UGGGACUCUUGUUCAGCUU | 5269 | AAGCUGAACAAGAGUCCCA | 5928 | 1474 |
| AD-26689 | CUUGUUCAGCUUCUGGGUU | 5270 | AACCCAGAAGCUGAACAAG | 5929 | 1481 |
| AD-26690 | UCAGCUUCUGGGUUCAGAU | 5271 | AUCUGAACCCAGAAGCUGA | 5930 | 1486 |
| AD-26691 | GCUUCUGGGUUCAGAUGAU | 5272 | AUCAUCUGAACCCAGAAGC | 5931 | 1489 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26692 | CUUCUGGGUUCAGAUGAUA | 5273 | UAUCAUCUGAACCCAGAAG | 5932 | 1490 |
| AD-26693 | GGCCAGGAUGCCUUGGGUA | 5274 | UACCCAAGGCAUCCUGGCC | 5933 | 2441 |
| AD-26694 | UUCUGGGUUCAGAUGAUAU | 5275 | AUAUCAUCUGAACCCAGAA | 5934 | 1491 |
| AD-26695 | CUGGGUUCAGAUGAUAUAA | 5276 | UUAUAUCAUCUGAACCCAG | 5935 | 1493 |
| AD-26696 | UGGGUUCAGAUGAUAUAAA | 5277 | UUUAUAUCAUCUGAACCCA | 5936 | 1494 |
| AD-26697 | GUCACCUGUGCAGCUGGAA | 5278 | UUCCAGCUGCACAGGUGAC | 5937 | 1517 |
| AD-26698 | UCACCUGUGCAGCUGGAAU | 5279 | AUUCCAGCUGCACAGGUGA | 5938 | 1518 |
| AD-26699 | CACCUGUGCAGCUGGAAUU | 5280 | AAUUCCAGCUGCACAGGUG | 5939 | 1519 |
| AD-26700 | CUGUGCAGCUGGAAUUCUU | 5281 | AAGAAUUCCAGCUGCACAG | 5940 | 1522 |
| AD-26701 | UGUGCAGCUGGAAUUCUUU | 5282 | AAAGAAUUCCAGCUGCACA | 5941 | 1523 |
| AD-26702 | GCAGCUGGAAUUCUUUCUA | 5283 | UAGAAAGAAUUCCAGCUGC | 5942 | 1526 |
| AD-26703 | CAGCUGGAAUUCUUUCUAA | 5284 | UUAGAAAGAAUUCCAGCUG | 5943 | 1527 |
| AD-26704 | UUUCUAACCUCACUUGCAA | 5285 | UUGCAAGUGAGGUUAGAAA | 5944 | 1539 |
| AD-26705 | UUCUAACCUCACUUGCAAU | 5286 | AUUGCAAGUGAGGUUAGAA | 5945 | 1540 |
| AD-26706 | ACCUCACUUGCAAUAAUUA | 5287 | UAAUUAUUGCAAGUGAGGU | 5946 | 1545 |
| AD-26707 | CCUCACUUGCAAUAAUUAU | 5288 | AUAAUUAUUGCAAGUGAGG | 5947 | 1546 |
| AD-26708 | CUCACUUGCAAUAAUUAUA | 5289 | UAUAAUUAUUGCAAGUGAG | 5948 | 1547 |
| AD-26709 | GUCUGCCAAGUGGGUGGUA | 5290 | UACCACCCACUUGGCAGAC | 5949 | 1580 |
| AD-26710 | UCUGCCAAGUGGGUGGUAU | 5291 | AUACCACCCACUUGGCAGA | 5950 | 1581 |
| AD-26711 | GGGUGGUAUAGAGGCUCUU | 5292 | AAGAGCCUCUAUACCACCC | 5951 | 1591 |
| AD-26712 | AUAGAGGCUCUUGUGCGUA | 5293 | UACGCACAAGAGCCUCUAU | 5952 | 1598 |
| AD-26713 | UCUUGUGCGUACUGUCCUU | 5294 | AAGGACAGUACGCACAAGA | 5953 | 1606 |
| AD-26714 | CUGGUGACAGGGAAGACAU | 5295 | AUGUCUUCCCUGUCACCAG | 5954 | 1629 |
| AD-26715 | ACAUCACUGAGCCUGCCAU | 5296 | AUGGCAGGCUCAGUGAUGU | 5955 | 1644 |
| AD-26716 | GCCUGCCAUCUGUGCUCUU | 5297 | AAGAGCACAGAUGGCAGGC | 5956 | 1654 |
| AD-26717 | UCUGACCAGCCGACACCAA | 5298 | UUGGUGUCGGCUGGUCAGA | 5957 | 1678 |
| AD-26718 | GACCAGCCGACACCAAGAA | 5299 | UUCUUGGUGUCGGCUGGUC | 5958 | 1681 |
| AD-26719 | GACACCAAGAAGCAGAGAU | 5300 | AUCUCUGCUUCUUGGUGUC | 5959 | 1689 |
| AD-26720 | AGCAGAGAUGGCCCAGAAU | 5301 | AUUCUGGGCCAUCUCUGCU | 5960 | 1699 |
| AD-26721 | GAUGGCCCAGAAUGCAGUU | 5302 | AACUGCAUUCUGGGCCAUC | 5961 | 1705 |
| AD-26722 | CCAGAAUGCAGUUCGCCUU | 5303 | AAGGCGAACUGCAUUCUGG | 5962 | 1711 |
| AD-26723 | AUGCAGUUCGCCUUCACUA | 5304 | UAGUGAAGGCGAACUGCAU | 5963 | 1716 |
| AD-26724 | UGCAGUUCGCCUUCACUAU | 5305 | AUAGUGAAGGCGAACUGCA | 5964 | 1717 |
| AD-26725 | UCGCCUUCACUAUGGACUA | 5306 | UAGUCCAUAGUGAAGGCGA | 5965 | 1723 |
| AD-26726 | UCACUAUGGACUACCAGUU | 5307 | AACUGGUAGUCCAUAGUGA | 5966 | 1729 |
| AD-26727 | UGGACUACCAGUUGUGGUU | 5308 | AACCACAACUGGUAGUCCA | 5967 | 1735 |
| AD-26728 | GGACUACCAGUUGUGGUUA | 5309 | UAACCACAACUGGUAGUCC | 5968 | 1736 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26729 | GACUACCAGUUGUGGUUAA | 5310 | UUAACCACAACUGGUAGUC | 5969 | 1737 |
| AD-26730 | CAGUUGUGGUUAAGCUCUU | 5311 | AAGAGCUUAACCACAACUG | 5970 | 1743 |
| AD-26731 | AGUUGUGGUUAAGCUCUUA | 5312 | UAAGAGCUUAACCACAACU | 5971 | 1744 |
| AD-26732 | AAGCUCUUACACCCACCAU | 5313 | AUGGUGGGUGUAAGAGCUU | 5972 | 1754 |
| AD-26733 | CAUCCCACUGGCCUCUGAU | 5314 | AUCAGAGGCCAGUGGGAUG | 5973 | 1770 |
| AD-26734 | AUCCCACUGGCCUCUGAUA | 5315 | UAUCAGAGGCCAGUGGGAU | 5974 | 1771 |
| AD-26735 | UCCCACUGGCCUCUGAUAA | 5316 | UUAUCAGAGGCCAGUGGGA | 5975 | 1772 |
| AD-26736 | UGGCCUCUGAUAAAGGCUA | 5317 | UAGCCUUUAUCAGAGGCCA | 5976 | 1778 |
| AD-26737 | UCUGAUAAAGGCUACUGUU | 5318 | AACAGUAGCCUUUAUCAGA | 5977 | 1783 |
| AD-26738 | AUAAAGGCUACUGUUGGAU | 5319 | AUCCAACAGUAGCCUUUAU | 5978 | 1787 |
| AD-26739 | GGCUACUGUUGGAUUGAUU | 5320 | AAUCAAUCCAACAGUAGCC | 5979 | 1792 |
| AD-26740 | UGUUGGAUUGAUUCGAAAU | 5321 | AUUUCGAAUCAAUCCAACA | 5980 | 1798 |
| AD-26741 | UGCCAUUCCACGACUAGUU | 5322 | AACUAGUCGUGGAAUGGCA | 5981 | 1861 |
| AD-26742 | UUCCACGACUAGUUCAGUU | 5323 | AACUGAACUAGUCGUGGAA | 5982 | 1866 |
| AD-26743 | ACGACUAGUUCAGUUGCUU | 5324 | AAGCAACUGAACUAGUCGU | 5983 | 1870 |
| AD-26744 | ACUAGUUCAGUUGCUUGUU | 5325 | AACAAGCAACUGAACUAGU | 5984 | 1873 |
| AD-26745 | GUUGCUUGUUCGUGCACAU | 5326 | AUGUGCACGAACAAGCAAC | 5985 | 1882 |
| AD-26746 | UGUUCGUGCACAUCAGGAU | 5327 | AUCCUGAUGUGCACGAACA | 5986 | 1888 |
| AD-26747 | GUUCGUGCACAUCAGGAUA | 5328 | UAUCCUGAUGUGCACGAAC | 5987 | 1889 |
| AD-26748 | GGUGGGACACAGCAGCAAU | 5329 | AUUGCUGCUGUGUCCCACC | 5988 | 1928 |
| AD-26749 | GUGGGACACAGCAGCAAUU | 5330 | AAUUGCUGCUGUGUCCCAC | 5989 | 1929 |
| AD-26750 | UGGGACACAGCAGCAAUUU | 5331 | AAAUUGCUGCUGUGUCCCA | 5990 | 1930 |
| AD-26751 | GGGGUCCGCAUGGAAGAAA | 5332 | UUUCUUCCAUGCGGACCCC | 5991 | 1955 |
| AD-26752 | GGGUCCGCAUGGAAGAAAU | 5333 | AUUUCUUCCAUGCGGACCC | 5992 | 1956 |
| AD-26753 | UCACAUCCUAGCUCGGGAU | 5334 | AUCCCGAGCUAGGAUGUGA | 5993 | 1999 |
| AD-26754 | CAUCCUAGCUCGGGAUGUU | 5335 | AACAUCCCGAGCUAGGAUG | 5994 | 2002 |
| AD-26755 | UAGCUCGGGAUGUUCACAA | 5336 | UUGUGAACAUCCCGAGCUA | 5995 | 2007 |
| AD-26756 | GGGAUGUUCACAACCGAAU | 5337 | AUUCGGUUGUGAACAUCCC | 5996 | 2013 |
| AD-26757 | GGAUGUUCACAACCGAAUU | 5338 | AAUUCGGUUGUGAACAUCC | 5997 | 2014 |
| AD-26758 | CAGAGGACUAAAUACCAUU | 5339 | AAUGGUAUUUAGUCCUCUG | 5998 | 2038 |
| AD-26759 | GGACUAAAUACCAUUCCAU | 5340 | AUGGAAUGGUAUUUAGUCC | 5999 | 2042 |
| AD-26760 | UAAAUACCAUUCCAUUGUU | 5341 | AACAAUGGAAUGGUAUUUA | 6000 | 2046 |
| AD-26761 | AAAUACCAUUCCAUUGUUU | 5342 | AAACAAUGGAAUGGUAUUU | 6001 | 2047 |
| AD-26762 | AUUGUUUGUGCAGCUGCUU | 5343 | AAGCAGCUGCACAAACAAU | 6002 | 2059 |
| AD-26763 | UUGUUUGUGCAGCUGCUUU | 5344 | AAAGCAGCUGCACAAACAA | 6003 | 2060 |
| AD-26764 | UGUUUGUGCAGCUGCUUUA | 5345 | UAAGCAGCUGCACAAACA | 6004 | 2061 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26765 | GUUUGUGCAGCUGCUUUAU | 5346 | AUAAAGCAGCUGCACAAAC | 6005 | 2062 |
| AD-26766 | UUUGUGCAGCUGCUUUAUU | 5347 | AAUAAAGCAGCUGCACAAA | 6006 | 2063 |
| AD-26767 | AGCUGCUUUAUUCUCCCAU | 5348 | AUGGGAGAAUAAAGCAGCU | 6007 | 2070 |
| AD-26768 | GCUGCUUUAUUCUCCCAUU | 5349 | AAUGGGAGAAUAAAGCAGC | 6008 | 2071 |
| AD-26769 | UUUAUUCUCCCAUUGAAAA | 5350 | UUUUCAAUGGGAGAAUAAA | 6009 | 2076 |
| AD-26770 | AUUCUCCCAUUGAAAACAU | 5351 | AUGUUUUCAAUGGGAGAAU | 6010 | 2079 |
| AD-26771 | UCCCAUUGAAAACAUCCAA | 5352 | UUGGAUGUUUUCAAUGGGA | 6011 | 2083 |
| AD-26772 | UGCAGGGGUCCUCUGUGAA | 5353 | UUCACAGAGGACCCCUGCA | 6012 | 2110 |
| AD-26773 | ACUUGCUCAGGACAAGGAA | 5354 | UUCCUUGUCCUGAGCAAGU | 6013 | 2128 |
| AD-26774 | CAGCUCCUCUGACAGAGUU | 5355 | AACUCUGUCAGAGGAGCUG | 6014 | 2178 |
| AD-26775 | AGCUCCUCUGACAGAGUUA | 5356 | UAACUCUGUCAGAGGAGCU | 6015 | 2179 |
| AD-26776 | UCCUCUGACAGAGUUACUU | 5357 | AAGUAACUCUGUCAGAGGA | 6016 | 2182 |
| AD-26777 | ACAGAGUUACUUCACUCUA | 5358 | UAGAGUGAAGUAACUCUGU | 6017 | 2189 |
| AD-26778 | AGUUACUUCACUCUAGGAA | 5359 | UUCCUAGAGUGAAGUAACU | 6018 | 2193 |
| AD-26779 | GUUACUUCACUCUAGGAAU | 5360 | AUUCCUAGAGUGAAGUAAC | 6019 | 2194 |
| AD-26780 | ACUUCACUCUAGGAAUGAA | 5361 | UUCAUUCCUAGAGUGAAGU | 6020 | 2197 |
| AD-26781 | GCUGCUGUUUUGUUCCGAA | 5362 | UUCGGAACAAAACAGCAGC | 6021 | 2234 |
| AD-26782 | CUGCUGUUUUGUUCCGAAU | 5363 | AUUCGGAACAAAACAGCAG | 6022 | 2235 |
| AD-26783 | GUCUGAGGACAAGCCACAA | 5364 | UUGUGGCUUGUCCUCAGAC | 6023 | 2254 |
| AD-26784 | UGAGGACAAGCCACAAGAU | 5365 | AUCUUGUGGCUUGUCCUCA | 6024 | 2257 |
| AD-26785 | ACAAGCCACAAGAUUACAA | 5366 | UUGUAAUCUUGUGGCUUGU | 6025 | 2262 |
| AD-26786 | AGCCACAAGAUUACAAGAA | 5367 | UUCUUGUAAUCUUGUGGCU | 6026 | 2265 |
| AD-26787 | AGAUUACAAGAAACGGCUU | 5368 | AAGCCGUUUCUUGUAAUCU | 6027 | 2272 |
| AD-26788 | CAAGAAACGGCUUUCAGUU | 5369 | AACUGAAAGCCGUUUCUUG | 6028 | 2278 |
| AD-26789 | AGCUGACCAGCUCUCUCUU | 5370 | AAGAGAGAGCUGGUCAGCU | 6029 | 2298 |
| AD-26790 | ACCAGCUCUCUCUUCAGAA | 5371 | UUCUGAAGAGAGCUGGU | 6030 | 2303 |
| AD-26791 | UAUUGGUGCCCAGGGAGAA | 5372 | UUCUCCCUGGGCACCAAUA | 6031 | 2365 |
| AD-26792 | CAGGGAGAACCCCUUGGAU | 5373 | AUCCAAGGGGUUCUCCCUG | 6032 | 2375 |
| AD-26793 | AGGGAGAACCCCUUGGAUA | 5374 | UAUCCAAGGGGUUCUCCCU | 6033 | 2376 |
| AD-26794 | CCUUGGAUAUCGCCAGGAU | 5375 | AUCCUGGCGAUAUCCAAGG | 6034 | 2386 |
| AD-26795 | UAUCGCCAGGAUGAUCCUA | 5376 | UAGGAUCAUCCUGGCGAUA | 6035 | 2393 |
| AD-26796 | GCCAGGAUGAUCCUAGCUA | 5377 | UAGCUAGGAUCAUCCUGGC | 6036 | 2397 |
| AD-26797 | CCAGGAUGAUCCUAGCUAU | 5378 | AUAGCUAGGAUCAUCCUGG | 6037 | 2398 |
| AD-26798 | GAUGAUCCUAGCUAUCGUU | 5379 | AACGAUAGCUAGGAUCAUC | 6038 | 2402 |
| AD-26799 | AUCCUAGCUAUCGUUCUUU | 5380 | AAAGAACGAUAGCUAGGAU | 6039 | 2406 |
| AD-26800 | UCCUAGCUAUCGUUCUUUU | 5381 | AAAAGAACGAUAGCUAGGA | 6040 | 2407 |
| AD-26801 | UCUUUUCACUCUGGUGGAU | 5382 | AUCCACCAGAGUGAAAAGA | 6041 | 2420 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26802 | CUUUUCACUCUGGUGGAUA | 5383 | UAUCCACCAGAGUGAAAAG | 6042 | 2421 |
| AD-26803 | UUUUCACUCUGGUGGAUAU | 5384 | AUAUCCACCAGAGUGAAAA | 6043 | 2422 |
| AD-26804 | UGGUGGAUAUGGCCAGGAU | 5385 | AUCCUGGCCAUAUCCACCA | 6044 | 2431 |
| AD-26805 | GAUAUGGCCAGGAUGCCUU | 5386 | AAGGCAUCCUGGCCAUAUC | 6045 | 2436 |
| AD-26806 | CCUUGGGUAUGGACCCCAU | 5387 | AUGGGGUCCAUACCCAAGG | 6046 | 2451 |
| AD-26807 | UGGGUAUGGACCCCAUGAU | 5388 | AUCAUGGGGUCCAUACCCA | 6047 | 2454 |
| AD-26808 | UUGUAAACUUGAUUAACUA | 5389 | UAGUUAAUCAAGUUUACAA | 6048 | 675 |
| AD-26809 | UGUAAACUUGAUUAACUAU | 5390 | AUAGUUAAUCAAGUUUACA | 6049 | 676 |
| AD-26810 | AAACUUGAUUAACUAUCAA | 5391 | UUGAUAGUUAAUCAAGUUU | 6050 | 679 |
| AD-26811 | UAUGGACCCCAUGAUGGAA | 5392 | UUCCAUCAUGGGGUCCAUA | 6051 | 2458 |
| AD-26812 | GGACCCCAUGAUGGAACAU | 5393 | AUGUUCCAUCAUGGGGUCC | 6052 | 2461 |
| AD-26813 | CCAUGAUGGAACAUGAGAU | 5394 | AUCUCAUGUUCCAUCAUGG | 6053 | 2466 |
| AD-26814 | ACCACCCUGGUGCUGACUA | 5395 | UAGUCAGCACCAGGGUGGU | 6054 | 2493 |
| AD-26815 | CCACCCUGGUGCUGACUAU | 5396 | AUAGUCAGCACCAGGGUGG | 6055 | 2494 |
| AD-26816 | UGCUGACUAUCCAGUUGAU | 5397 | AUCAACUGGAUAGUCAGCA | 6056 | 2503 |
| AD-26817 | AGUUGAUGGGCUGCCAGAU | 5398 | AUCUGGCAGCCCAUCAACU | 6057 | 2515 |
| AD-26818 | UGCCCAGGACCUCAUGGAU | 5399 | AUCCAUGAGGUCCUGGGCA | 6058 | 2542 |
| AD-26819 | GCAAUCAGCUGGCCUGGUU | 5400 | AACCAGGCCAGCUGAUUGC | 6059 | 2580 |
| AD-26820 | CAAUCAGCUGGCCUGGUUU | 5401 | AAACCAGGCCAGCUGAUUG | 6060 | 2581 |
| AD-26821 | GGUUUGAUACUGACCUGUA | 5402 | UACAGGUCAGUAUCAAACC | 6061 | 2595 |
| AD-26822 | AUACUGACCUGUAAAUCAU | 5403 | AUGAUUUACAGGUCAGUAU | 6062 | 2601 |
| AD-26823 | UGACCUGUAAAUCAUCCUU | 5404 | AAGGAUGAUUUACAGGUCA | 6063 | 2605 |
| AD-26824 | GACCUGUAAAUCAUCCUUU | 5405 | AAAGGAUGAUUUACAGGUC | 6064 | 2606 |
| AD-26825 | ACCUGUAAAUCAUCCUUUA | 5406 | UAAAGGAUGAUUUACAGGU | 6065 | 2607 |
| AD-26826 | AAUACAAAUGAUGUAGAAA | 5407 | UUUCUACAUCAUUUGUAUU | 6066 | 878 |
| AD-26900 | UUUUAAGAAUAUCUGUAAU | 5408 | AUUACAGAUAUUCUUAAAA | 6067 | 2745 |
| AD-26901 | UACAGCAAUUUCUAAUUUU | 5409 | AAAAUUAGAAAUUGCUGUA | 6068 | 2872 |
| AD-26902 | CACUAAUUCAUAAUCACUC | 5410 | GAGUGAUUAUGAAUUAGUG | 6069 | 2915 |
| AD-26903 | ACUAAUUCAUAAUCACUCU | 5411 | AGAGUGAUUAUGAAUUAGU | 6070 | 2916 |
| AD-26904 | UAAUUCAUAAUCACUCUAA | 5412 | UUAGAGUGAUUAUGAAUUA | 6071 | 2918 |
| AD-26905 | AAUUCAUAAUCACUCUAAU | 5413 | AUUAGAGUGAUUAUGAAUU | 6072 | 2919 |
| AD-26906 | AAUUGUAAUCUGAAUAAAG | 5414 | CUUUAUUCAGAUUACAAUU | 6073 | 2939 |
| AD-26907 | UUUGUAUAAAUAGACAAA | 5415 | UUUGUCUAUUUUAUACAAA | 6074 | 2978 |
| AD-26908 | UUGUAUAAAAUAGACAAAU | 5416 | AUUUGUCUAUUUUAUACAA | 6075 | 2979 |
| AD-26909 | UGUAUAAAAUAGACAAAUA | 5417 | UAUUUGUCUAUUUUAUACA | 6076 | 2980 |
| AD-26910 | GUAUAAAAUAGACAAAUAG | 5418 | CUAUUUGUCUAUUUUAUAC | 6077 | 2981 |

TABLE 2-continued

RNAi Agents to Beta-Catenin: Unmodified Sequences

| DUPLEX | SENSE SEQUENCE | SENSE SEQ ID NO: | ANTI-SENSE SEQUENCE | Anti-sense SEQ ID NO: | POSITION |
|---|---|---|---|---|---|
| AD-26911 | AUAAAAUAGACAAAUAGAA | 5419 | UUCUAUUUGUCUAUUUUAU | 6078 | 2983 |
| AD-26912 | UAAAAUAGACAAAUAGAAA | 5420 | UUUCUAUUUGUCUAUUUUA | 6079 | 2984 |
| AD-26913 | AAAUAGACAAAUAGAAAAU | 5421 | AUUUUCUAUUUGUCUAUUU | 6080 | 2986 |
| AD-26914 | UGGGAUAUGUAUGGGUAGG | 5422 | CCUACCCAUACAUAUCCCA | 6081 | 3081 |
| AD-26915 | GGGAUAUGUAUGGGUAGGG | 5423 | CCCUACCCAUACAUAUCCC | 6082 | 3082 |
| AD-26916 | CUAAUUCAUAAUCACUCUA | 5424 | UAGAGUGAUUAUGAAUUAG | 6083 | 2917 |
| AD-26917 | AAAUAGAAAAUGGUCCAAU | 5425 | AUUGGACCAUUUUCUAUUU | 6084 | 2994 |
| AD-26918 | AAUAGAAAAUGGUCCAAUU | 5426 | AAUUGGACCAUUUUCUAUU | 6085 | 2995 |
| AD-26919 | UUUGGACAGUUUACCAGUU | 5427 | AACUGGUAAACUGUCCAAA | 6086 | 3134 |
| AD-26920 | AUUCUUUCUAACCUCACUU | 5428 | AAGUGAGGUUAGAAAGAAU | 6087 | 1535 |
| AD-26921 | UGGAUUGAUUCGAAAUCUU | 5429 | AAGAUUUCGAAUCAAUCCA | 6088 | 1801 |
| SET1_1245 | GACCCCAAGCUUUAGUAAA | 6090 | UUUACUAAAGCUUGGGGUC | 6111 | 1227 |
| SET1_1249 | CCAAGCUUUAGUAAAUAUA | 6091 | UAUAUUUACUAAAGCUUGG | 6112 | 1231 |
| SET1_1250 | CAAGCUUUAGUAAAUAUAA | 6092 | UUAUAUUUACUAAAGCUUG | 6113 | 1232 |
| SET1_1450 | UUCAGAUGCUGCAACUAAA | 6093 | UUUAGUUGCAGCAUCUGAA | 6114 | 1432 |
| SET1_1545 | CAGCUGGAAUUCUUUCUAA | 6094 | UUAGAAAGAAUUCCAGCUG | 6115 | 1527 |
| SET1_1755 | GACUACCAGUUGUGGUUAA | 6095 | UUAACCACAACUGGUAGUC | 6116 | 1737 |
| SET1_1814 | ACUGUUGGAUUGAUUCGAA | 6096 | UUCGAAUCAAUCCAACAGU | 6117 | 1796 |
| SET1_1816 | UGUUGGAUUGAUUCGAAAU | 6097 | AUUUCGAAUCAAUCCAACA | 6118 | 1798 |
| SET1_1974 | GGGUCCGCAUGGAAGAAAU | 6098 | AUUUCUUCCAUGCGGACCC | 6119 | 1956 |
| SET1_2202 | CUCUGACAGAGUUACUUCA | 6099 | UGAAGUAACUCUGUCAGAG | 6120 | 2184 |
| SET1_2425 | UCCUAGCUAUCGUUCUUUU | 6100 | AAAAGAACGAUAGCUAGGA | 6121 | 2407 |
| SET1_254 | CCAUACAACUGUUUUGAAA | 6101 | UUUCAAAACAGUUGUAUGG | 6122 | 236 |
| SET1_3146 | AAGUGAAGAAUGCACAAGA | 6102 | UCUUGUGCAUUCUUCACUU | 6123 | 3128 |
| SET1_3169 | AUCACAAGAUGGAAUUUAU | 6103 | AUAAAUUCCAUCUUGUGAU | 6124 | 3151 |
| SET1_3196 | AGCCUUGCUUGUUAAAUUU | 6104 | AAAUUUAACAAGCAAGGCU | 6125 | 3178 |
| SET1_3477 | AAUAGAAAAUGGUCCAAUU | 6105 | AAUUGGACCAUUUUCUAUU | 6126 | 3459 |
| SET1_703 | GAUUAACUAUCAAGAUGAU | 6106 | AUCAUCUUGAUAGUUAAUC | 6127 | 685 |
| SET1_709 | CUAUCAAGAUGAUGCAGAA | 6107 | UUCUGCAUCAUCUUGAUAG | 6128 | 691 |
| SET1_865 | GAUGGUGUCUGCUAUUGUA | 6108 | UACAAUAGCAGACACCAUC | 6129 | 847 |
| SET1_889 | CAUGCAGAAUACAAAUGAU | 6109 | AUCAUUUGUAUUCUGCAUG | 6130 | 871 |
| SET1_895 | GAAUACAAAUGAUGUAGAA | 6110 | UUCUACAUCAUUUGUAUUC | 6131 | 877 |

Modified sequences are listed in Table 3; the specific modifications are disclosed herein. The sequences in Table 2 correspond to portions of the wild-type Beta-Catenin gene without modifications or dTdT extensions. The positions are also provided. In the sequences in these tables, lower-case letters (e.g., c, u) indicate modified nucleotides while upper case letters (e.g., C, U, A, G) indicate unmodified nucleotides. In Table 3, modified versions of the sequences are shown. However, the present disclosure encompasses unmodified versions of these sequences and other versions which comprise additional or alternative modifications. Thus, for example, AD-18892 can optionally have the unmodified sequence uGGuGcuGAcuAuccAGuu (SEQ ID NO: 429) in the sense strand and AACUGGAuAGUcAGcACcA (SEQ ID NO: 430) in the anti-sense strand. The present disclosure also encompasses alternative modified versions of the duplex comprising uGGuGcuGAcuAuccA-Guu (SEQ ID NO: 429) in the sense strand and AACUG-GAuAGUcAGcACcA (SEQ ID NO: 430) in the anti-sense strand.

In the sequences in Tables 1, 2 and 3, the modified and unmodified sequences can optionally comprise the sequence "dTsdT" or "UU" at the 3' end. In the sequences disclosed herein, the TT and UU dinucleotides were not in the inverted/reverse orientation and "UU" is 2'-OMe-U 2'-OMe-U.

Thus, for example, AD-18892 can optionally have the modified sequence uGGuGcuGAcuAuccAGuudTdT (SEQ ID NO: 6132) or uGGuGcuGAcuAuccAGuudTsdT (SEQ ID NO: 6133) in the sense strand; and AACUGGAuAGUcA-GcACcAdTdT (SEQ ID NO: 6134) or AACUGGAuAGU-cAGcACcAdTsdT (SEQ ID NO: 6135) in the anti-sense strand. As noted in Table 3, below, dT is 2'-deoxy-thymidine-5'-phosphate and sdT is 2'-deoxy Thymidine 5'-phosphorothioate.

In several sequences in this Table, the nickname "Set1_#" can be preceded by the prefix "hsCTNNB1_". Thus "Set1_254" is also designated "hsCTNNB1_Set1_254". The number is derived from one type of calculation of the position on the gene. Thus, the designations Set1_1245, Set1_1249, Set1_1250, Set1_1450, Set1_1545, Set1_1755, Set1_1814, Set1_1816, Set1_1974, Set1_2202, Set1_2425, Set1_254, Set1_3146, Set1_3169, Set1_3196, Set1_3477, Set1_703, Set1_709, Set1_865, Set1_889, Set1_895 indicate duplexes (or modified variants thereof) which correspond to one type of calculation of the positions 1245, 1249, 1250, 1450, 1545, 1755, 1814, 1816, 1974, 2202, 2425, 254, 3146, 3169, 3196, 3477, 703, 709, 865, 889, 895, respectively. However, these positions were calculated using different parameters than other sequences in this Table, resulting in a 18 nt shift. Thus, "Set1_254" pertains to a sequence which corresponds to position 236. Also note that the underscore (_) is sometimes replaced by a space ( ); thus, for example, "Set1_3169" is the same as "Set1 3169"; and "hsCTNNB1_Set2_254_A48_S26" is the same as "hsCTNNB1 Set2 254 A48 S26".

In addition, additional suffixes can be appended to the nickname to designate different variants which have the same sequence (e.g., the same sequence of nucleotides), but different modifications. Thus, assorted variants of duplexes within "hsCTNNB1_Set1_1245" include, inter alia: hsCTNNB1_Set1_254_A22_S26;
hsCTNNB1_Set1_254_A25_S27;
hsCTNNB1_Set1_254_A_LO_V1_S26;
hsCTNNB1_Set1_254_A_LO_V2_S_Lo_V1;
hsCTNNB1_Set2_254_A_LO_V3_S_Lo_V2;
hsCTNNB1_Set2_254_A_LO_V4_S_LO_V1;
hsCTNNB1_Set2_254_A_LO_V5_S_LO_V1; and
hsCTNNB1_Set2_254_A48_S26.

TABLE 3

Beta-Catenin RNAi agents: Example Modified Sequences

| Duplex | Sense Sequence | Sense SEQ ID NO: | Anti-sense Sequence | Anti-sense SEQ ID NO: | Position |
| --- | --- | --- | --- | --- | --- |
| AD-18892 | uGGuGcuGAcuAuccAGuu | 1 | AACUGGAuAGUcAGcACcA | 6497 | 2500 |
| AD-18893 | ccAucuGuGcucuucGucA | 2 | UGACGAAGAGcAcAGAUGG | 661 | 1659 |
| AD-18894 | AuAAGcAGGuGGAucuAuu | 3 | AAuAGAUCcACCUGCUuAU | 662 | 3038 |
| AD-18895 | AuccAAAGAGuAGcuGcAG | 4 | CUGcAGCuACUCUUUGGAU | 663 | 2096 |
| AD-18896 | GAcAAuGGcuAcucAAGcu | 5 | AGCUUGAGuAGCcAUUGUC | 664 | 265 |
| AD-18897 | cuGuuGGAuuGAuucGAAA | 6 | UUUCGAAUcAAUCcAAcAG | 665 | 1797 |
| AD-18898 | GcuGGccuGuuuGAuAcu | 7 | AGuAUcAAACcAGGCcAGC | 666 | 2587 |
| AD-18899 | ucuAAccucAcuuGcAAuA | 8 | uAUUGcAAGUGAGGUuAGA | 667 | 1541 |
| AD-18900 | GAuAucGccAGGAuGAucc | 9 | GGAUcAUCCUGGCGAuAUC | 668 | 2391 |
| AD-18901 | uGGccAucuuuAAGucuGG | 10 | CcAGACUuAAAGAUGGCcA | 669 | 954 |
| AD-18902 | uGuAGAAcAcuAAuucAuA | 11 | uAUGAAUuAGUGUUCuAcA | 670 | 2908 |
| AD-18903 | AucAGuAAGAGGuGuuAuu | 12 | AAuAAcACCUCUuACUGAU | 671 | 3104 |
| AD-18904 | GuGcucuucGucAucuGAc | 13 | GUcAGAUGACGAAGAGcAC | 672 | 1665 |
| AD-18905 | uGGuuuGAuAcuGAccuGu | 14 | AcAGGUcAGuAUcAAAccA | 673 | 2594 |
| AD-18906 | ccAGuuGccuuuuAucccA | 15 | UGGGAuAAAAGGcAACUGG | 674 | 3147 |
| AD-18907 | ccuGGuuuGAuAcuGAccu | 16 | AGGUcAGuAUcAAAccAGG | 675 | 2592 |
| AD-18908 | GAcuAuccAGuuGAuGGGc | 17 | GCCcAUcAACUGGAuAGUC | 676 | 2507 |
| AD-18909 | AGccAAuGGcuuGGAAuGA | 18 | UcAUUCcAAGCcAUUGGCU | 677 | 2325 |
| AD-18910 | GccAAuGGcuuGGAAuGAG | 19 | CUcAUUCcAAGCcAUUGGC | 678 | 2326 |
| AD-18911 | AGAuGAGGGcAuGcAGAuc | 20 | GAUCUGcAUGCCCUcAUCU | 679 | 577 |
| AD-18912 | GGuccucuGuGAAcuuGcu | 21 | AGcAAGUUcAcAGAGGACC | 680 | 2116 |
| AD-18913 | AAcccuAGccuuGcuuGuu | 22 | AAcAAGcAAGGCuAGGGUU | 681 | 2708 |
| AD-18914 | GAAcAcuAAuucAuAAucA | 23 | UGAUuAUGAAUuAGUGUUC | 682 | 2912 |
| AD-18915 | AucAAAcccuAGccuuGcu | 24 | AGcAAGGCuAGGGUUUGAU | 683 | 2704 |
| AD-18916 | AccAGuuGccuuuuAuccc | 25 | GGGAuAAAAGGcAACUGGU | 684 | 3146 |
| AD-18917 | cuAAccucAcuuGcAAuAA | 26 | UuAUUGcAAGUGAGGUuAG | 685 | 1542 |
| AD-18918 | AucccAcuAAuGuccAGcG | 27 | CGCUGGAcAUuAGUGGGAU | 686 | 621 |
| AD-18919 | cuGAcuAuccAGuuGAuGG | 28 | CcAUcAACUGGAuAGUcAG | 687 | 2505 |
| AD-18920 | GGccuGGuuuGAuAcuGAc | 29 | GUcAGuAUcAAACcAGGCC | 688 | 2590 |
| AD-18921 | GGuAAAucAGuAAGAGGuG | 30 | cACCUCUuACUGAUUuACC | 689 | 3099 |
| AD-18922 | GccuGGuuuGAuAcuGAcc | 31 | GGUcAGuAUcAAACcAGGC | 690 | 2591 |
| AD-18923 | cAGGGGuccucuGuGAAcu | 32 | AGUUcAcAGAGGACCCCUG | 691 | 2112 |
| AD-18925 | cuGGAAuccAucuGGuGc | 33 | GcACcAGAAUGGAUUCcAG | 692 | 366 |
| AD-18926 | uGAGuGGGuGGccAccAc | 34 | GUGGUGGCcACCcAUCUcA | 693 | 2479 |
| AD-18927 | GAuGAuAuAAAuGuGGucA | 35 | UGACcAcAUUuAuAUcAUC | 694 | 1502 |
| AD-18928 | uGcuuuAuucucccAuuGA | 36 | UcAAUGGGAGAAuAAAGcA | 695 | 2073 |
| AD-18929 | uuAucAAAcccuAGccuuG | 37 | cAAGGCuAGGGUUUGAuAA | 696 | 2702 |

TABLE 3-continued

Beta-Catenin RNAi agents: Example Modified Sequences

| | | | | | |
|---|---|---|---|---|---|
| AD-18930 | ccAcuGGccucuGAuAAAG | 38 | CUUuAUcAGAGGCcAGUGG | 697 | 1774 |
| AD-18931 | AAcuuGccAcAcGuGcAAu | 39 | AUUGcACGUGUGGcAAGUU | 698 | 708 |
| AD-18932 | GcucuucGucAucuGAccA | 40 | UGGUcAGAUGACGAAGAGC | 699 | 1667 |
| AD-18933 | GuAAcAAuAcAAAuGGAuu | 41 | AAUCcAUUUGuAUUGUuAC | 700 | 2629 |
| AD-18934 | GGGGuccucuGuGAAcuuG | 42 | cAAGUUcAcAGAGGACCCC | 701 | 2114 |
| AD-18935 | cAAAcccuAGccuuGcuuG | 43 | cAAGcAAGGCuAGGGUUUG | 702 | 2706 |
| AD-18936 | GAGuAAuGGuGuAGAAcAc | 44 | GUGUUCuAcACcAUuACUC | 703 | 2899 |
| AD-18937 | GGAAGAcAucAcuGAGccu | 45 | AGGCUcAGUGAUGUCUUCC | 704 | 1639 |
| AD-18938 | GGGAAGAcAucAcuGAGcc | 46 | GGCUcAGUGAUGUCUUCCC | 705 | 1638 |
| AD-18939 | GGuGuAGAAcAcuAAuucA | 47 | UGAAUuAGUGUUCuAcACC | 706 | 2906 |
| AD-18940 | uAccAGuuGccuuuuAucc | 48 | GGAuAAAAGGcAACUGGuA | 707 | 3145 |
| AD-18941 | GGAuAucGccAGGAuGAuc | 49 | GAUcAUCCUGGCGAuAUCC | 708 | 2390 |
| AD-18942 | AAAcccuAGccuuGcuuGu | 50 | AcAAGcAAGGCuAGGGUUU | 709 | 2707 |
| AD-18943 | cucuucGucAucuGAccAG | 51 | CUGGUcAGAUGACGAAGAG | 710 | 1668 |
| AD-18944 | uGAcuAuccAGuuGAuGGG | 52 | CCcAUcAACUGGAuAGUcA | 711 | 2506 |
| AD-18945 | AcAAGcAGAGuGcuGAAGG | 53 | CCUUcAGcACUCUGCUUGU | 712 | 1286 |
| AD-18946 | cAucuGuGcucuucGucAu | 54 | AUGACGAAGcAcAGAUG | 713 | 1660 |
| AD-18947 | cAAuGGcuuGGAAuGAGAc | 55 | GUCUcAUUCcAAGCcAUUG | 714 | 2328 |
| AD-18948 | AcuGGccucuGAuAAAGGc | 56 | GCCUUuAUcAGAGGCcAGU | 715 | 1776 |
| AD-18949 | ucAucccAcuAAuGccAG | 57 | CUGGAcAUuAGUGGGAUGA | 716 | 619 |
| AD-18950 | AAAAGGAAGcuuccAGAcA | 58 | UGUCUGGAAGCUUCCUUUU | 717 | 807 |
| AD-18951 | cGuucuuuucAcucuGGuG | 59 | cACcAGAGUGAAAAGAACG | 718 | 2417 |
| AD-18952 | AAAGuuGuuGuAAccuGcu | 60 | AGcAGGUuAcAAcAACUUU | 719 | 3165 |
| AD-18953 | AcAAuGGcuAcucAAGcuu | 61 | cAGCUUGAGuAGCcAUUGU | 720 | 266 |
| AD-18954 | cucAucccAcuAAuGccA | 62 | UGGAcAUuAGUGGGAUGAG | 721 | 618 |
| AD-18955 | AGGGGuccucuGuGAAcuu | 63 | AAGUUcAcAGAGGACCCCU | 722 | 2113 |
| AD-18956 | AAGcAGGuGGAucuAuuuc | 64 | GAAAuAGAUCcACCUGCUU | 723 | 3040 |
| AD-18957 | AAGuuGuuGuAAccuGcuG | 65 | cAGcAGGUuAcAAcAACUU | 724 | 3166 |
| AD-18958 | AGcAGGuGGAucuAuuucA | 66 | UGAAAuAGAUCcACCUGCU | 725 | 3041 |
| AD-18959 | AGGGcAuGcAGAucccAuc | 67 | GAUGGGAUCUGcAUGCCCU | 726 | 582 |
| AD-18960 | AAAuGGuucAGAAuuAAAc | 68 | GUUuAAUUCUGAACcAUUU | 727 | 3220 |
| AD-18961 | uGAAcuuGcucAGGAcAAG | 69 | CUUGUCCUGAGcAAGUUcA | 728 | 2125 |
| AD-18962 | AAGAGuAGcuGcAGGGGuc | 70 | GACCCCUGcAGCuACUCUU | 729 | 2101 |
| AD-18963 | cccAcuGGccucuGAuAAA | 71 | UUuAUcAGAGGCcAGUGGG | 730 | 1773 |
| AD-18964 | cuGGccuGGuuuGAuAcuG | 72 | cAGuAUcAAAccAGGCcAG | 731 | 2588 |
| AD-18965 | uuGAuAcuGAccuGuAAAu | 73 | AUUuAcAGGUcAGuAUcAA | 732 | 2598 |
| AD-18966 | GuGuAGAAcAcuAAuucAu | 74 | AUGAAUuAGUGUUCuAcAC | 733 | 2907 |
| AD-18967 | AcuAuccAGuuGAuGGGcu | 75 | AGCCcAUcAACUGGAuAGU | 734 | 2508 |
| AD-18968 | AAAucAGuAAGAGGuGuuA | 76 | uAAcACCUCUuACUGAUUU | 735 | 3102 |
| AD-18969 | GcAGGuGGAucuAuuucAu | 77 | AUGAAAuAGAUCcACCUGC | 736 | 3042 |
| AD-18970 | cuGGuGcuGAcuAuccAGu | 78 | ACUGGAuAGUcAGcAccAG | 737 | 2499 |
| AD-18971 | GuGAAcuuGcucAGGAcAA | 79 | UUGUCCUGAGcAAGUUcAC | 738 | 2124 |
| AD-18972 | ucAGuAAGAGGuGuuAuuu | 80 | AAAuAAcACCUCUuACUGA | 739 | 3105 |
| AD-18973 | ccucuGuGAAcuuGcucAG | 81 | CUGAGcAAGUUcAcAGAGG | 740 | 2119 |
| AD-18974 | uuGGcuGAAccAucAcAGA | 82 | UCUGUGAUGGUUcAGCcAA | 741 | 641 |
| AD-18975 | ucAGcuGGccuGGuuuGAu | 83 | AUcAAACcAGGCcAGCUGA | 742 | 2584 |
| AD-18976 | GuAGcuGcAGGGGuccucu | 84 | AGAGGACCCCUGcAGCuAC | 743 | 2105 |
| AD-18977 | AGGAGcuAAAAuGGcAGuG | 85 | cACUGCcAUUUuAGCUCCU | 744 | 1069 |
| AD-18978 | AuGGcuuGGAAuGAGAcuG | 86 | cAGUCUcAUUCcAAGCcAU | 745 | 2330 |
| AD-18979 | uuGGAuAucGccAGGAuGA | 87 | UcAUCCUGGCGAuAUCcAA | 746 | 2388 |
| AD-18980 | GGuucAGAAuuAAAcuuuu | 88 | AAAAGUUuAAUUCUGAACC | 747 | 3224 |
| AD-18981 | GGGuAAucAGuAAGAGGu | 89 | ACCUCUuACUGAUUuACCC | 748 | 3098 |
| AD-18982 | AuAccAuuccAuuGuuuGu | 90 | AcAAAcAAUGGAAUGGuAU | 749 | 2049 |
| AD-18983 | AcuGuuGGAuuGAuucGAA | 91 | UUCGAAUcAAUCcAAcAGU | 750 | 1796 |
| AD-18984 | AAcuuGcucAGGAcAAGGA | 92 | UCCUUGUCCUGAGcAAGUU | 751 | 2127 |
| AD-18985 | AuGcuuAAAAuAAGcAGGu | 93 | ACCUGCUuAUUUuAAGcAU | 752 | 3029 |
| AD-18986 | GuuuGAuAcuGAccuGuAA | 94 | UuAcAGGUcAGuAUcAAAC | 753 | 2596 |
| AD-18987 | AAuGGuucAGAAuuAAAcu | 95 | AGUUuAAUUCUGAACcAUU | 754 | 3221 |
| AD-18988 | uAucccAAAGuuGuuGuAA | 96 | UuAcAAcAACUUUGGGAuA | 755 | 3159 |
| AD-18989 | AucAGcuGGccuGGuuuGA | 97 | UcAAACcAGGCcAGCUGAU | 756 | 2583 |
| AD-18990 | ccuGccAucuGuGcucuuc | 98 | GAAGAGcAcAGAUGGcAGG | 757 | 1655 |
| AD-18991 | GcAGAuAcAAAuGAuGuA | 99 | uAcAUcAUUUGuAUUCUGC | 758 | 874 |
| AD-18992 | uAuGcuuAAAAuAAGcAGG | 100 | CCUGCUuAUUUuAAGcAuA | 759 | 3028 |
| AD-18993 | AAuAAGcAGGuGGAucuAu | 101 | AuAGAUCcACCUGCUuAUU | 760 | 3037 |
| AD-18994 | uGAuAAAAuGuGGucAcc | 102 | GGUGACcAcAUUuAuAUcA | 761 | 1504 |
| AD-18995 | GuAGGGuAAAucAGuAAGA | 103 | UCUuACUGAUuuACCCuAC | 762 | 3095 |
| AD-18996 | uAucAAAcccuAGccuuGc | 104 | GcAAGGCuAGGGUUUGAuA | 763 | 2703 |
| AD-18997 | ccuuuuAucccAAAGuuGu | 105 | AcAACUUUGGGAuAAAAGG | 764 | 3154 |
| AD-18998 | GGuAGGGuAAAucAGuAAG | 106 | CUuACUGAUUuACCCuACC | 765 | 3094 |
| AD-18999 | uGAuAcuGAccuGuAAAuc | 107 | GAUUuAcAGGUcAGuAUcA | 766 | 2599 |
| AD-19000 | GGcuGAAccAucAcAGAuG | 108 | cAUCUGUGAUGGUUcAGCC | 767 | 643 |
| AD-19001 | uGGAuAucGccAGGAuGAu | 109 | AUcAUCCUGGCGAuAUCcA | 768 | 2389 |
| AD-19002 | ucuucGucAucuGAccAGc | 110 | GCUGGUcAGAUGACGAAGA | 769 | 1669 |
| AD-19003 | uAGcuGcAGGGGuccucuG | 111 | cAGAGGACCCCUGcAGCuA | 770 | 2106 |
| AD-19004 | uGuuGuAAccuGcuGuGAu | 112 | AUcAcAGcAGGUuAcAAcA | 771 | 3170 |
| AD-19005 | AAucAGuAAGAGGuGuuAu | 113 | AuAAcACCUCUuACUGAUU | 772 | 3103 |
| AD-19006 | uGGcuGAAccAucAcAGAu | 114 | AUCUGUGAUGGUUcAGCcA | 773 | 642 |
| AD-19007 | GAAuuAAAcuuuuAAuucA | 115 | UGAAUuAAAAGUUuAAUUC | 774 | 3230 |

TABLE 3-continued

Beta-Catenin RNAi agents: Example Modified Sequences

| | | | | | | |
|---|---|---|---|---|---|---|
| AD-19008 | AuGGuucAGAAuuAAAcuu | 116 | AAGUUuAAUUCUGAACcAU | 775 | 3222 |
| AD-19009 | uGGuGuAGAAcAcuAAuuc | 117 | GAAUuAGUGUUCuAcACcA | 776 | 2905 |
| AD-19010 | AuGuGuAGAAcAcuAAuu | 118 | AAUuAGUGUUCuAcACcAU | 777 | 2904 |
| AD-19011 | AuGAGGGcAuGcAGAuccc | 119 | GGGAUCUGcAUGCCCUcAU | 778 | 579 |
| AD-19012 | GuuGuAAccuGcuGAuA | 120 | uAUcAcAGcAGGUuAcAAC | 779 | 3171 |
| AD-19042 | GcuGAcuAuccAGuuGAuG | 121 | cAUcAACUGGAuAGUcAGC | 780 | 2504 |
| AD-19043 | uAAGcAGGuGGAucuAuuu | 122 | AAAAuAGAUCcACCUGCUuA | 781 | 3039 |
| AD-19044 | uAAAAuAAGcAGGuGGAuc | 123 | GAUCcACCUGCUuAUUUuA | 782 | 3034 |
| AD-19045 | GAuAuAAAuGuGGucAccu | 124 | AGGUGACcAcAUUuAuAUC | 783 | 1505 |
| AD-19046 | AAGcAGAGuGcuGAAGGuG | 125 | cACCUUcAGcACUCUGCUU | 784 | 1288 |
| AD-19047 | uGuGAAcuuGcucAGGAcA | 126 | UGUCCUGAGcAAGUUcAcA | 785 | 2123 |
| AD-19048 | cAucccAcuAAuGccAGc | 127 | GCUGGAcAUuAGUGGGAUG | 786 | 620 |
| AD-19049 | cAAAGuuGuuGuAAccuGc | 128 | GcAGGUuAcAAcAACUUUG | 787 | 3164 |
| AD-19050 | uAAAucAGuAAGAGGuGuu | 129 | AAcACCUCUuACUGAUUuA | 788 | 3101 |
| AD-19051 | AAuGGcuuGGAAuGAGAcu | 130 | AGUCUcAUUCcAAGCcAUU | 789 | 2329 |
| AD-19052 | GGGuccucuGuGAAcuuGc | 131 | GcAAGUUcAcAGAGGACCC | 790 | 2115 |
| AD-19053 | GAGuAAcAAuAcAAAuGGA | 132 | UCcAUUUGuAUUGUuACUC | 791 | 2627 |
| AD-19054 | uAAuGGuGuAGAAcAcuAA | 133 | UuAGUGUUCuAcACcAUuA | 792 | 2902 |
| AD-19055 | GuGGAcAAuGGcuAcucAA | 134 | UUGAGuAGCcAUUGUCcAC | 793 | 262 |
| AD-19056 | AAcuGucuuuGGAcucucA | 135 | UGAGAGUCcAAAGAcAGUU | 794 | 1406 |
| AD-19057 | cccuuGuGcuGAcuAuccA | 136 | UGGAuAGUcAGcACcAGGG | 795 | 2497 |
| AD-19058 | cAGGuGGAucuAuuucAuG | 137 | cAUGAAAuAGAUCcACCUG | 796 | 3043 |
| AD-19059 | uGGccuGGuuuGAuAcuGA | 138 | UcAGuAUcAAACcAGGCcA | 797 | 2589 |
| AD-19060 | AGcuGGccuGGuuuGAuAc | 139 | GuAUcAAACcAGGCcAGCU | 798 | 2586 |
| AD-19061 | GccAucuGuGcucuucGuc | 140 | GACGAAGAGcAcAGAUGGC | 799 | 1658 |
| AD-19062 | uAccAuuccAuuGuuuGuG | 141 | cAcAAAcAAUGGAAUGGuA | 800 | 2050 |
| AD-19063 | cccuuGGAuAucGccAGGA | 142 | UCCUGGCGAuAUCcAAGGG | 801 | 2385 |
| AD-19064 | AGGGAAGAcAucAcuGAGc | 143 | GCUcAGUGAUGUCUUCCCU | 802 | 1637 |
| AD-19065 | GAAcuuGccAcAcGuGcAA | 144 | UUGcACGUGUGGcAAGUUC | 803 | 707 |
| AD-19066 | uuuGAuAcuGAccuGuAAA | 145 | UUuAcAGGUcAGuAUcAAA | 804 | 2597 |
| AD-19067 | ucccAAAGuuGuuGuAAcc | 146 | GGUuAcAAcAACUUUGGGA | 805 | 3161 |
| AD-19068 | cAGAAuAcAAAuGAuGuAG | 147 | CuAcAUcAUUUGuAUUCUG | 806 | 875 |
| AD-19069 | AGGuGGAucuAuuucAuGu | 148 | AcAUGAAAuAGAUCcACCU | 807 | 3044 |
| AD-19070 | GcucAucccAcuAAuGucc | 149 | GGAcAUuAGUGGGAUGAGC | 808 | 617 |
| AD-19071 | ccuGGuGcuGAcuAuccAG | 150 | CUGGAuAGUcAGcACcAGG | 809 | 2498 |
| AD-19072 | uGGAAuccAuucuGGuGcc | 151 | GGcACcAGAAUGGAUUCcA | 810 | 367 |
| AD-19073 | ccAGGAccucAuGGAuGGG | 152 | CCcAUCcAUGAGGUCCUGG | 811 | 2545 |
| AD-19074 | AAccucAcuGcAuAAuu | 153 | AAUuAUUGcAAGUGAGGUU | 812 | 1544 |
| AD-19075 | cAGuuGccuuuuAcccAA | 154 | UUGGGAuAAAAGGcAACUG | 813 | 3148 |
| AD-19076 | GuAGAAcAcuAAuucAuAA | 155 | UuAUGAAUuAGUGUUCuAC | 814 | 2909 |
| AD-19077 | cuAuccAGuuGAuGGGcuG | 156 | cAGCCcAUcAACUGGAuAG | 815 | 2509 |
| AD-19078 | cAcuGccucuGAuAAAGG | 157 | CCUUuAUcAGAGGCcAGUG | 816 | 1775 |
| AD-19079 | AcuGucuuuGGAcucucAG | 158 | CUGAGAGUCcAAAGAcAGU | 817 | 1407 |
| AD-19080 | ccAAuGGcuuGGAAuGAGA | 159 | UCUcAUUCcAAGCcAUUGG | 818 | 2327 |
| AD-19081 | GcuuAAAAuAAGcAGGuGG | 160 | CcACCUGCUuAUUUuAAGC | 819 | 3031 |
| AD-19082 | AucuGuGcucuucGucAuc | 161 | GAUGACGAAGAGcAcAGAU | 820 | 1661 |
| AD-19083 | cccAAAGuuGuuGuAAccu | 162 | AGGUuAcAAcAACUUUGGG | 821 | 3162 |
| AD-19738 | uAcccAGcGccAcGucc | 163 | GGACGuACGGCGCUGGGuA | 822 | 1906 |
| AD-19739 | AcGcuAucAuGcGuuccuc | 164 | GGAGAACGcAUGAuAGCGU | 823 | 825 |
| AD-19740 | cAuGcAccuuuGcGuGAGc | 165 | GCUcACGcAAAGGUGcAUG | 824 | 1838 |
| AD-19741 | GAAuGcAGuucGccuucAc | 166 | GUGAAGGCGAACUGcAUUC | 825 | 1714 |
| AD-19742 | GGuGccAuuccAcGAcuAG | 167 | CuAGUCGUGGAUGGcACC | 826 | 1859 |
| AD-19743 | AAGcGGcuGuuAGucAcuG | 168 | cAGUGACuAAcAGCCGCUU | 827 | 324 |
| AD-19744 | ucGAGcucAGAGGGuAcGA | 169 | UCGuACCCUCUGAGCUCGA | 828 | 535 |
| AD-19745 | GAcAcGcuAucAuGcGuuc | 170 | GAACGcAUGAuAGCGUGUC | 829 | 822 |
| AD-19746 | cGcuAucAuGcGuucuccu | 171 | AGGAGAACGcAUGAuAGCG | 830 | 826 |
| AD-19747 | GuGucuGcuAuuGuAcGuA | 172 | uACGuAcAAuAGcAGAcAC | 831 | 851 |
| AD-19748 | GucuGcucuAGuAuAAGc | 173 | GCUuAUuACuAGAGcAGAC | 832 | 1313 |
| AD-19749 | GuGccAuuccAcGAcuAGu | 174 | ACuAGUCGUGGAAUGGcAC | 833 | 1860 |
| AD-19750 | AuGuucAcAAccGAAuuGu | 175 | AcAAUUCGGUUGUGAAcAU | 834 | 2016 |
| AD-19751 | ccAcGAcuAGuucAGuuGc | 176 | GcAACUGAACuAGUCGUGG | 835 | 1868 |
| AD-19752 | cAcGAcuAGuucAGuuGcu | 177 | AGcAACUGAACuAGUCGUG | 836 | 1869 |
| AD-19753 | AGuucAGuuGcuuGuucGu | 178 | ACGAAcAAGcAACUGAACU | 837 | 1876 |
| AD-19754 | cccAGcGccGuAcGuccAu | 179 | AUGGACGuACGGCGCUGGG | 838 | 1908 |
| AD-19755 | GAGuuAcuucAcucuAGGA | 180 | UCCuAGAGUGAAGuAACUC | 839 | 2192 |
| AD-19756 | AcAGuAuGcAAuGAcucGA | 181 | UCGAGUcAUUGcAuACUGU | 840 | 520 |
| AD-19757 | uAuGcAAuGAcucGAGcuc | 182 | GAGCUCGAGUcAUUGcAuA | 841 | 524 |
| AD-19758 | cccAcuAAuGuccAGcGuu | 183 | AACGCUGGAcAUuAGUGGG | 842 | 623 |
| AD-19759 | GAccuuGcAuAAccuuucc | 184 | GGAAAGGUuAUGcAAGGUC | 843 | 916 |
| AD-19760 | uAuuAcGAcAGAcuGccuu | 185 | AAGGcAGUCUGUCGuAAuA | 844 | 1153 |
| AD-19761 | AucuGAccAGccGAcAccA | 186 | UGGUGUCGGCUGGUcAGAU | 845 | 1677 |
| AD-19762 | cAuuccAcGAcuAGuucAG | 187 | CUGAACuAGUCGUGGAAUG | 846 | 1864 |
| AD-19763 | GuuuGAAAAuccAGcGuG | 188 | cACGCUGGAUUUUcAAAAC | 847 | 246 |
| AD-19764 | GcGuuuGGcuGAAccAucA | 189 | UGAUGGUUcAGCcAAACGC | 848 | 637 |
| AD-19765 | AcAcGcuAucAuGcGuucu | 190 | AGAACGcAUGAuAGCGUGU | 849 | 823 |
| AD-19766 | uAuGccAuuAcAAcucucc | 191 | GGAGAGUUGuAAUGGcAuA | 850 | 1028 |
| AD-19767 | ucuGcucuAGuAAuAAGcc | 192 | GGCuAUuACuAGAGcAGA | 851 | 1314 |
| AD-19768 | cGGGAuGuucAcAAccGAA | 193 | UUCGGUUGUGAAcAUCCCG | 852 | 2012 |
| AD-20124 | | | | | |

TABLE 3-continued

Beta-Catenin RNAi agents: Example Modified Sequences

| | | | | | |
|---|---|---|---|---|---|
| AD-25889 | AcAAuAcAAAuGGAuuuuG | 194 | cAAAAUCcAUUUGuAUUGU | 853 | 2632 |
| AD-25890 | AcAAAuGGAuuuuGGGAGu | 195 | ACUCCcAAAAUCcAUUUGU | 854 | 2637 |
| AD-25891 | uuGGGAGuGAcucAAGAAG | 196 | CUUCUUGAGUcACUCCcAA | 855 | 2648 |
| AD-25892 | uGGGAGuGAcucAAGAAGu | 197 | ACUUCUUGAGUcACUCCcA | 856 | 2649 |
| AD-25893 | GAAGuGAAGAAuGcAcAAG | 198 | CUUGUGcAUUCUUcACUUC | 857 | 2663 |
| AD-25894 | AAGuGAAGAAuGcAcAAGA | 199 | UCUUGUGcAUUCUUcACUU | 858 | 2664 |
| AD-25895 | GAuGGAAuuuAucAAAccc | 200 | GGGUUUGAuAAAUUCcAUC | 859 | 2694 |
| AD-25896 | AuGGAAuuuAucAAAcccu | 201 | AGGGUUUGAuAAAUUCcAU | 860 | 2695 |
| AD-25897 | GGAAuuuAucAAAcccuAG | 202 | CuAGGGUUUGAuAAAUUCC | 861 | 2697 |
| AD-25898 | GAAuuuAucAAAcccuAGc | 203 | GCuAGGGUUUGAuAAAUUC | 862 | 2698 |
| AD-25899 | AAuuuAucAAAcccuAGcc | 204 | GGCuAGGGUUUGAuAAAUU | 863 | 2699 |
| AD-25900 | GAAuAucuGuAAuGGuAcu | 205 | AGuACcAUuAcAGAuAUUC | 864 | 2751 |
| AD-25901 | AAuAucuGuAAuGGuAcuG | 206 | cAGuACcAUuAcAGAuAUU | 865 | 2752 |
| AD-25902 | AuAucuGuAAuGGuAcuGA | 207 | UcAGuACcAUuAcAGAuAU | 866 | 2753 |
| AD-25903 | uuuuAAGcucucGuAGuG | 208 | cACuACGAGAGACUuAAAA | 867 | 2832 |
| AD-25904 | uuuuAAGcucucGuAGuGu | 209 | AcACuACGAGAGACUuAAA | 868 | 2833 |
| AD-25905 | AGucucucGuAGuGuuAAG | 210 | CUuAAcACuACGAGAGACU | 869 | 2837 |
| AD-25906 | ucGuAGuGuuAAGuuAuAG | 211 | CuAuAACuuAAcACuACGA | 870 | 2843 |
| AD-25907 | cGuAGuGuuAAGuuAuAGu | 212 | ACuAuAACuuAAcACuACG | 871 | 2844 |
| AD-25908 | GuAGuGuuAAGuuAuAGuG | 213 | cACuAuAACuuAAcACuAC | 872 | 2845 |
| AD-25909 | uAGuGuuAAGuuAuAGuGA | 214 | UcACuAuAACuuAAcACuA | 873 | 2846 |
| AD-25910 | uAGuGAAuAcuGcuAcAGc | 215 | GCUGuAGcAGuAUUcACuA | 874 | 2859 |
| AD-25911 | AAcAcuAAuucAuAAucAc | 216 | GUGAUuAUGAAuuAGUGUU | 875 | 2913 |
| AD-25912 | AcAcuAAuucAuAAucAcu | 217 | AGUGAUuAUGAAuuAGUGU | 876 | 2914 |
| AD-25913 | uAAuuGuAAcuGAAuAAA | 218 | UUuAUUcAGAUuAcAAUuA | 877 | 2938 |
| AD-25914 | AuuGuAAcuGAAuAAAGu | 219 | ACUUuAUUcAGAUuAcAAU | 878 | 2940 |
| AD-25915 | uuGuAAcuGAAuAAAGuG | 220 | cACUUuAUUcAGAUuAcAA | 879 | 2941 |
| AD-25916 | uGuAAucuGAAuAAAGuGu | 221 | AcACUUuAUUcAGAUuAcA | 880 | 2942 |
| AD-25917 | GAcAAAuAGAAAAuGGucc | 222 | GGAccAUUUUcuAUUUGUC | 881 | 2991 |
| AD-25918 | AcAAAuAGAAAAuGGuccA | 223 | UGGACcAUUUUcuAUUUGU | 882 | 2992 |
| AD-25919 | uAGAAAAuGGuccAAuuAG | 224 | CuAAUUGGACcAUUUUcuA | 883 | 2997 |
| AD-25920 | AGAAAAuGGuccAAuuAGu | 225 | ACuAAUUGGACcAUUUUCU | 884 | 2998 |
| AD-25921 | uAuuuGGGAuAuGuAuGGG | 226 | CCcAuAcAuAUCCcAAAuA | 885 | 3077 |
| AD-25922 | AuuuGGGAuAuGuAuGGGu | 227 | ACCcAuAcAuAUCCcAAAU | 886 | 3078 |
| AD-25923 | uuGGGAuAuGuAuGGGuAG | 228 | CuACCcAuAcAuAUCCcAA | 887 | 3080 |
| AD-25924 | GGAuAuGuAuGGGuAGGGu | 229 | ACCCuACCcAuAcAuAUCC | 888 | 3083 |
| AD-25925 | AAGAGGuGuuAuuuGGAAc | 230 | GUUCcAAAuAAcACCUCUU | 889 | 3110 |
| AD-25926 | AGAGGuGuuAuuuGGAAcc | 231 | GGUUCcAAAuAAcACCUCU | 890 | 3111 |
| AD-25927 | GAGGuGuuAuuuGGAACCu | 232 | AGGUUCcAAAuAAcACCUC | 891 | 3112 |
| AD-25928 | uGGAAccuuGuuuuGGAcA | 233 | UGUCcAAAAcAAGGUUCcA | 892 | 3123 |
| AD-25929 | GGAAccuuGuuuuGGAcAG | 234 | CUGUCcAAAAcAAGGUUCC | 893 | 3124 |
| AD-25930 | GAAccuuGuuuuGGAcAGu | 235 | ACUGUCcAAAAcAAGGUUC | 894 | 3125 |
| AD-25931 | GuuuuGGAcAGuuuAccAG | 236 | CUGGuAAACUGUCcAAAAC | 895 | 3132 |
| AD-25932 | uuuuGGAcAGuuuAccAGu | 237 | ACUGGuAAACUGUCcAAAA | 896 | 3133 |
| AD-25933 | uuGGAcAGuuuAccAGuuG | 238 | cAACUGGuAAACUGUCcAA | 897 | 3135 |
| AD-25934 | GuuGuuAAccuGcuGuG | 239 | cAcAGcAGGUuAcAAcAAC | 898 | 3168 |
| AD-25935 | uuGuuGuAAccuGcuGuGA | 240 | UcAcAGcAGGUuAcAAcAA | 899 | 3169 |
| AD-25936 | uuGuAAccuGcuGuGAuc | 241 | GuAUcAcAGcAGGUuAcAA | 900 | 3172 |
| AD-25937 | AuGcuucAAGAGAAAAuGc | 242 | GcAUUUUCUCUUGAAGcAU | 901 | 3192 |
| AD-25938 | AGuGAAGAAuGcAcAAGAA | 243 | UUCUUGUGcAUUCUUcACU | 902 | 2665 |
| AD-25939 | AAuGGAucAcAAGAuGGAA | 244 | UUCcAUCUUGUGAUCcAUU | 903 | 2682 |
| AD-25940 | AuGGAucAcAAGAuGGAAu | 245 | AUUCcAUCUUGUGAUCcAU | 904 | 2683 |
| AD-25941 | uGGAucAcAAGAuGGAAuu | 246 | AAUUCcAUCUUGUGAUCcA | 905 | 2684 |
| AD-25942 | GGAucAcAAGAuGGAAuuu | 247 | AAAUUCcAUCUUGUGAUCC | 906 | 2685 |
| AD-25943 | GAucAcAAGAuGGAAuuuA | 248 | uAAAUUCcAUCUUGUGAUC | 907 | 2686 |
| AD-25944 | AucAcAAGAuGGAAuuuAu | 249 | AuAAAUUCcAUCUUGUGAU | 908 | 2687 |
| AD-25945 | uGGAAuuuAucAAAcccuA | 250 | uAGGGUUUGAuAAAUUCcA | 909 | 2696 |
| AD-25946 | AcccuAGccuuGcuuGuuA | 251 | uAAcAAGcAAGGCuAGGGU | 910 | 2709 |
| AD-25947 | cccuAGccuuGcuuGuuAA | 252 | UuAAcAAGcAAGGCuAGGG | 911 | 2710 |
| AD-25948 | ccuAGccuuGcuuGuuAAA | 253 | UUuAAcAAGcAAGGCuAGG | 912 | 2711 |
| AD-25949 | cuAGccuuGcuuGuuAAAu | 254 | AUUuAAcAAGcAAGGCuAG | 913 | 2712 |
| AD-25950 | uAGccuuGcuuGuuAAAuu | 255 | AAUUuAAcAAGcAAGGCuA | 914 | 2713 |
| AD-25951 | AGccuuGcuuGuuAAAuuu | 256 | AAAUUuAAcAAGcAAGGCU | 915 | 2714 |
| AD-25952 | uuuAAGcucucGuAGuGuu | 257 | AAcACuACGAGAGACUuAA | 916 | 2834 |
| AD-25953 | uAAGcucucGuAGuGuuAA | 258 | UuAAcACuACGAGAGACUu | 917 | 2835 |
| AD-25954 | AAGcucucGuAGuGuuAA | 259 | UuAAcACuACGAGAGACUU | 918 | 2836 |
| AD-25955 | cucGuAGuGuuAAGuuAuA | 260 | uAuAACUuAAcACuACGAG | 919 | 2842 |
| AD-25956 | AGuGuuAAGuuAuAGuGAA | 261 | UUcACuAuAACUuAAcACU | 920 | 2847 |
| AD-25957 | GuGuuAAGuuAuAGuGAAu | 262 | AUUcACuAuAACUuAAcAC | 921 | 2848 |
| AD-25958 | cuAcAGcAAuucuAAuuu | 263 | AAAUuAGAAUUGCUGuAG | 922 | 2871 |
| AD-25959 | cAAuAGAAAAuGGuccAA | 264 | UUGGACcAUUUUcuAUUUG | 923 | 2993 |
| AD-25960 | AuAGAAAAuGGuccAAuuA | 265 | uAAUUGGACcAUUUUcuAU | 924 | 2996 |
| AD-25961 | uuuGGGAuAuGuAuGGGuA | 266 | uACCCuAcAuAUCCcAAA | 925 | 3079 |
| AD-25962 | GAuAuGuAuGGGuAGGGuA | 267 | uACCCuACCcAuAcAuAUC | 926 | 3084 |
| AD-25963 | uGGGuAGGGuAAAucAGuA | 268 | uACUGAUUuACCCuACCCA | 927 | 3092 |
| AD-25964 | uAAGAGGuGuuAuuuGGAA | 269 | UUCcAAAuAAcACCUCUuA | 928 | 3109 |
| AD-26017 | uGccuuuuAucccAAAGuu | 270 | AACUUUGGGAuAAAAGGcA | 929 | 3152 |
| AD-26018 | uGuuGuAAccuGcuGuGAu | 271 | AUcAcAGcAGGUuAcAAcA | 930 | 3170 |

TABLE 3-continued

Beta-Catenin RNAi agents: Example Modified Sequences

| | | | | | | |
|---|---|---|---|---|---|---|
| AD-26019 | GuuGuAAccuGcuGuGAuA | 272 | uAUcAcAGcAGGUuAcAAC | 931 | 3171 |
| AD-26020 | cAAGAGAAAAuGcGGuuAu | 273 | AuAACCGcAUUUUCUCUUG | 932 | 3198 |
| AD-26021 | AAGAGAAAAuGcGGuuAuA | 274 | uAuAACCGcAUUUUCUCUU | 933 | 3199 |
| AD-26022 | ccuGuuccccuGAGGGuAu | 275 | AuACCCUcAGGGGAAcAGG | 934 | 207 |
| AD-26023 | cuGuuccccuGAGGGuAuu | 276 | AAuACCCUcAGGGGAAcAG | 935 | 208 |
| AD-26024 | ccuGAGGGuAuuuGAAGuA | 277 | uACUUcAAAuACCCUcAGG | 936 | 215 |
| AD-26025 | cuGAGGGuAuuuGAAGuAu | 278 | AuACUUcAAAuACCCUcAG | 937 | 216 |
| AD-26026 | uGAGGGuAuuuGAAGuAuA | 279 | uAuACUUcAAAuACCCUcA | 938 | 217 |
| AD-26027 | GGuAuuuGAAGuAuAccAu | 280 | AUGGuAuACUUcAAAuACC | 939 | 221 |
| AD-26028 | GuAuuuGAAGuAuAccAuA | 281 | uAUGGuAuACUUcAAAuAC | 940 | 222 |
| AD-26029 | uuuGAAGuAuAccAuAcAA | 282 | UUGuAUGGuAuACUUcAAA | 941 | 225 |
| AD-26030 | AGuAuAccAuAcAAcuGuu | 283 | AAcAGUUGuAUGGuAuACU | 942 | 230 |
| AD-26031 | GuAuAccAuAcAAcuGuuu | 284 | AAAcAGUUGuAUGGuAuAC | 943 | 231 |
| AD-26032 | uAuAccAuAcAAcuGuuuu | 285 | AAAAcAGUUGuAUGGuAuA | 944 | 232 |
| AD-26033 | AccAuAcAAcuGuuuuGAA | 286 | UUcAAAAcAGUUGuAUGGU | 945 | 235 |
| AD-26034 | ccAuAcAAcuGuuuuGAAA | 287 | UUUcAAAAcAGUUGuAUGG | 946 | 236 |
| AD-26035 | GAAAAuccAGcGuGGAcAA | 288 | UUGUCcACGCUGGAUUUUC | 947 | 251 |
| AD-26036 | AAAAuccAGcGuGGAcAAu | 289 | AUUGUCcACGCUGGAUUUU | 948 | 252 |
| AD-26037 | ccAGcGuGGAcAAuGGcuA | 290 | uAGCcAUUGUCcACGCUGG | 949 | 257 |
| AD-26038 | GuGGAcAAuGGcuAcucAA | 291 | UUGAGuAGCcAUUGUCcAC | 950 | 262 |
| AD-26039 | AAuGGcuAcucAAGcuGAu | 292 | AUcAGCUUGAGuAGCcAUU | 951 | 268 |
| AD-26040 | AuGGcuAcucAAGcuGAuu | 293 | AAUcAGCUUGAGuAGCcAU | 952 | 269 |
| AD-26041 | uGGcuAcucAAGcuGAuuu | 294 | AAAUcAGCUUGAGuAGCcA | 953 | 270 |
| AD-26042 | cuAcucAAGcuGAuuuGAu | 295 | AUcAAAUcAGCUUGAGuAG | 954 | 273 |
| AD-26043 | AuuuGAuGGAGuuGGAcAu | 296 | AUGUCcAACUCcAUcAAAU | 955 | 285 |
| AD-26044 | uGGAGuuGGAcAuGGccAu | 297 | AUGGCcAUGUCcAACUCcA | 956 | 291 |
| AD-26045 | GuuGGAcAuGGccAuGGAA | 298 | UUCcAUGGCcAUGUCcAAC | 957 | 295 |
| AD-26046 | GccAuGGAAccAGAcAGAA | 299 | UUCUGUCUGGUUCcAUGGC | 958 | 305 |
| AD-26047 | cAuGGAAccAGAcAGAAAA | 300 | UUUUCUGUCUGGUUCcAUG | 959 | 307 |
| AD-26048 | GGAGGcGGAGAcGGAGGAA | 301 | UUCCUCCGUCUCCGCCUCC | 960 | 111 |
| AD-26049 | AGAcAGAAAAGcGGcuGuu | 302 | AACAGCCGCUUUUCUGUCU | 961 | 316 |
| AD-26050 | GAcAGAAAAGcGGcuGuuA | 303 | uAAcAGCCGCUUUUCUGUC | 962 | 317 |
| AD-26051 | uGuuAGucAcuGGcAGcAA | 304 | UUGCUGCcAGUGACuAAcA | 963 | 331 |
| AD-26052 | cAcuGGcAGcAAcAGucuu | 305 | AAGACUGUUGCUGCcAGUG | 964 | 338 |
| AD-26053 | AcuGGcAGcAAcAGucuuA | 306 | uAAGACUGUUGCUGCcAGU | 965 | 339 |
| AD-26054 | ucuuAccuGGAcucuGGAA | 307 | UUCcAGAGUCcAGGuAAGA | 966 | 353 |
| AD-26055 | cuuAccuGGAcucuGGAAu | 308 | AUUCcAGAGUCcAGGuAAG | 967 | 354 |
| AD-26056 | ccuGGAcucuGGAAuccAu | 309 | AUGGAUUCcAGAGUCcAGG | 968 | 358 |
| AD-26057 | GGcuAGuGGuGGAccccAA | 310 | UUGGGGUCcACcACuAGCC | 969 | 1216 |
| AD-26058 | GccAcuAccAcAGcuccuu | 311 | AAGGAGCUGUGGuAGUGGC | 970 | 383 |
| AD-26059 | uccuucucuGAGuGuAAAA | 312 | UUuACcACUcAGAGAAGGA | 971 | 397 |
| AD-26060 | cucuGAGuGGuAAAGGcAA | 313 | UUGCCUUuACcACUcAGAG | 972 | 402 |
| AD-26061 | uAAAGGcAAuccuGAGGAA | 314 | UUCCUcAGGAUUGCCUUuA | 973 | 412 |
| AD-26062 | cAAuccuGAGGAAGAGGAA | 315 | AUCCUCUUCCUcAGGAUUG | 974 | 418 |
| AD-26063 | uGAGGAAGAGGAuGuGGAu | 316 | AUCcAcAUCCUCUUCCUcA | 975 | 424 |
| AD-26064 | AuAccucccAAGuccuGuA | 317 | uAcAGGACUUGGGAGGuAU | 976 | 441 |
| AD-26065 | uAccucccAAGuccuGuAu | 318 | AuAcAGGACUUGGGAGGuA | 977 | 442 |
| AD-26066 | AGuccuGuAuGAGuGGGAu | 319 | UUCCcACUcAuAcAGGACU | 978 | 451 |
| AD-26067 | uAuGAGuGGGAAcAGGGAu | 320 | AUCCCUGUUCCcACUcAuA | 979 | 458 |
| AD-26068 | cAAGcuuuAGuAAAuAuAA | 321 | UuAuAUUuACuAAAGCUUG | 980 | 1232 |
| AD-26069 | AAGcuuuAGuAAAuAuAAu | 322 | AUuAuAUUuACuAAAGCUU | 981 | 1233 |
| AD-26070 | uGAGuGGGAACAGGGAuuu | 323 | AAAUCCCUGUUCCcACUcA | 982 | 460 |
| AD-26071 | GAGuGGGAACAGGGAuuuu | 324 | AAAAUCCCUGUUCCcACUC | 983 | 461 |
| AD-26072 | AGGGAuuuucucAGuccuu | 325 | AAGGACUGAGAAAAUCCCU | 984 | 471 |
| AD-26073 | uucucAGuccuucAcucAA | 326 | UUGAGUGAAGGACUGAGAA | 985 | 478 |
| AD-26074 | ucAGuccuucAcucAAGAA | 327 | UUCUUGAGUGAAGGACUGA | 986 | 481 |
| AD-26075 | cuucAcucAAGAAcAAGuA | 328 | uACUUGUUCUUGAGUGAAG | 987 | 487 |
| AD-26076 | ucAAGAAcAAGuAGcuGAu | 329 | AUcAGCuACUUGUUCUUGA | 988 | 493 |
| AD-26077 | cuGAuAuuGAuGGAcAGuA | 330 | uACUGUCcAUcAAuAUcAG | 989 | 507 |
| AD-26078 | AuuGAuGGAcAGuAuGcAA | 331 | UUGcAuACUGUCcAUcAAU | 990 | 512 |
| AD-26079 | GAcucGAGcucAGAGGGuA | 332 | uACCCUCUGAGCUCGAGUC | 991 | 532 |
| AD-26080 | cAGAGGGuAcGAGcuGcuA | 333 | uAGcAGCUCGuACCCUCUG | 992 | 542 |
| AD-26081 | AGAGGGuAcGAGcuGcuAu | 334 | AuAGcAGCUCGuACCCUCU | 993 | 543 |
| AD-26082 | GGGuAcGAGcuGcuAuGuu | 335 | AAcAuAGcAGCUCGuACCC | 994 | 546 |
| AD-26083 | cuAuGuucccuGAGAcAuu | 336 | AAUGUCUcAGGGAAcAuAG | 995 | 558 |
| AD-26084 | uAuGuucccuGAGAcAuuA | 337 | uAAUGUCUcAGGGAAcAuA | 996 | 559 |
| AD-26085 | GuucccuGAGAcAuuAGAu | 338 | AUCuAAUGUCUcAGGGAAC | 997 | 562 |
| AD-26086 | uAGAuGAGGGcAuGcAGAu | 339 | AUCUGcAUGCCCUcAUCuA | 998 | 576 |
| AD-26087 | GAGGGcAuGcAGAucccAu | 340 | AUGGGAUCUGcAUGCCCUC | 999 | 581 |
| AD-26088 | GGcAuGcAGAucccAucuA | 341 | uAGAUGGGAUCUGcAUGCC | 1000 | 584 |
| AD-26089 | AGAucccAucuAcAcAGuu | 342 | AACUGUGuAGAUGGGAUCU | 1001 | 591 |
| AD-26090 | cccAucuAcAcAGuuuGAu | 343 | AUcAAACUGUGuAGAUGGG | 1002 | 595 |
| AD-26091 | AcACuGuuGAUGGcAUcAA | 344 | AUGAGcGAUcAAAcUGU | 1003 | 604 |
| AD-26092 | GAuGcuGcuAucccAcuAA | 345 | uAGUGGGAUGAGcAGcAUC | 1004 | 611 |
| AD-26093 | AuGcuGcuAucccAcuAAu | 346 | UuAGUGGGAUGAGcAGcAU | 1005 | 612 |
| AD-26094 | uGcuGcuAucccAcuAAuu | 347 | AUuAGUGGGAUGAGcAGcA | 1006 | 613 |
| AD-26095 | cccAcuAAuGuccAGcGuu | 348 | AACGCUGGAcAUuAGUGGG | 1007 | 623 |
| AD-26096 | cAGcGuuuGGcuGAAccAu | 349 | AUGGUUcAGCcAAACGCUG | 1008 | 635 |

TABLE 3-continued

Beta-Catenin RNAi agents: Example Modified Sequences

| | | | | | |
|---|---|---|---|---|---|
| AD-26097 | uGGcuGAAccAucAcAGAu | 350 | AUCUGUGAUGGUUcAGCcA | 1009 | 642 |
| AD-26098 | AAccAucAcAGAuGcuGAA | 351 | UUcAGcAUCUGUGAUGGUU | 1010 | 648 |
| AD-26099 | AccAucAcAGAuGcuGAAA | 352 | UUUcAGcAUCUGUGAUGGU | 1011 | 649 |
| AD-26100 | AucAcAGAuGcuGAAAcAu | 353 | AUGUUUcAGcAUCUGUGAU | 1012 | 652 |
| AD-26101 | GAuGcuGAAAcAuGcAGuu | 354 | AACUGcAUGUUUcAGcAUC | 1013 | 658 |
| AD-26102 | cuGAAAcAuGcAGuuGuAA | 355 | UuAcAACUGcAUGUUUcAG | 1014 | 662 |
| AD-26103 | AAcAuGcAGuuGuAAAcuu | 356 | AAGUUuAcAACUGcAUGUU | 1015 | 666 |
| AD-26104 | AuGcAGuuGuAAAcuuGAu | 357 | AUcAAGUUuAcAACUGcAU | 1016 | 669 |
| AD-26105 | uGcAGuuGuAAAcuuGAuu | 358 | AAUcAAGUUuAcAACUGcA | 1017 | 670 |
| AD-26106 | cAGuuGuAAAcuuGAuuAA | 359 | UuAAUcAAGUUuAcAACUG | 1018 | 672 |
| AD-26107 | cuuGAuuAAcuAucAAGAu | 360 | AUCUUGAuAGUuAAUcAAG | 1019 | 682 |
| AD-26108 | GAuuAAcuAucAAGAuGAu | 361 | AUcAUCUUGAuAGUuAAUC | 1020 | 685 |
| AD-26109 | cuAucAAGAuGAuGcAGAA | 362 | UUcUGcAUcAUCUUGAuAG | 1021 | 691 |
| AD-26110 | GAAcuuGccAcAcGuGcAA | 363 | UUGcACGUGUGGcAAGUUC | 1022 | 707 |
| AD-26111 | AAcuuGccAcAcGuGcAAu | 364 | AUUGcACGUGUGGcAAGUU | 1023 | 708 |
| AD-26112 | cAcGuGcAAucccuGAA | 365 | UUcAGGGAUUGcACGUGUG | 1024 | 715 |
| AD-26123 | GcAAucccuGAAcuGAcAA | 366 | UUGUcAGUUcAGGGAUUGC | 1025 | 722 |
| AD-26124 | cAAucccuGAAcuGAcAAA | 367 | UUUGUcAGUUcAGGGAUUG | 1026 | 723 |
| AD-26125 | AAucccuGAAcuGAcAAAA | 368 | UUUUGUcAGUUcAGGGAUU | 1027 | 724 |
| AD-26126 | uGAAcuGAcAAAAcuGcuA | 369 | uAGcAGUUUUGUcAGUUcA | 1028 | 730 |
| AD-26127 | GAAcuGAcAAAAcuGcuAA | 370 | UuAGcAGUUUUGUcAGUUC | 1029 | 731 |
| AD-26128 | AAcuGAcAAAAcuGcuAAA | 371 | UUuAGcAGUUUUGUcAGUU | 1030 | 732 |
| AD-26129 | AcuGAcAAAAcuGcuAAAu | 372 | AUUuAGcAGUUUUGUcAGU | 1031 | 733 |
| AD-26130 | GAGGAccAGGuGGuGGuuA | 373 | uAACcACcACCUGGUCCUC | 1032 | 755 |
| AD-26131 | AGGAccAGGuGGuGGuuAA | 374 | UuAACcACcACCUGGUCCU | 1033 | 756 |
| AD-26132 | GGAccAGGuGGuGGuuAAu | 375 | AUuAACcACcACCUGGUCC | 1034 | 757 |
| AD-26133 | GAccAGGuGGuGGuuAAuA | 376 | uAUuAACcACcACCUGGUC | 1035 | 758 |
| AD-26134 | ucAcuuGcAAuAAuuAuAA | 377 | UuAuAAUuAUUGcAAGUGA | 1036 | 1548 |
| AD-26135 | cuuGcAAuAAuuAuAAGAA | 378 | UUcUuAuAAUuAUUGcAAG | 1037 | 1551 |
| AD-26136 | AccAGGuGGuGGuuAAuAA | 379 | UuAUuAACcACcACCUGGU | 1038 | 759 |
| AD-26137 | GGcuGcAGuuAuGGuccAu | 380 | AUGGAccAuAACUGcAGCC | 1039 | 778 |
| AD-26138 | GuuAuGGuccAucAGcuuu | 381 | AAAGCUGAUGGAccAuAAC | 1040 | 785 |
| AD-26139 | AuGGuccAucAGcuuucA | 382 | uAGAAAGCUGAUGGAccAU | 1041 | 788 |
| AD-26140 | uGGuccAucAGcuuucuAA | 383 | UuAGAAAGCUGAUGGAccA | 1042 | 789 |
| AD-26141 | ucGGGcuGGAcAGGGAA | 384 | UUCCCUGUcAccAGCCCGA | 1043 | 1624 |
| AD-26142 | GGuccAucAGcuuucuAAA | 385 | UUuAGAAAGCUGAUGGACC | 1044 | 790 |
| AD-26143 | GuccAucAGcuuucuAAAA | 386 | UUUuAGAAAGCUGAUGGAC | 1045 | 791 |
| AD-26144 | GAAGcuuccAGAcAcGcuA | 387 | uAGCGUGUCUGGAAGCUUC | 1046 | 812 |
| AD-26145 | AAGcuuccAGAcAcGcuAu | 388 | AuAGCGUGUCUGGAAGCUU | 1047 | 813 |
| AD-26146 | cuuccAGAcAcGcuAucAu | 389 | AUGAuAGCGUGUCUGGAAG | 1048 | 816 |
| AD-26147 | AGAcAcGcuAucAuGcGuu | 390 | AACGcAUGAuAGCGUGUCU | 1049 | 821 |
| AD-26148 | ucAuGcGuucuccucAGAu | 391 | AUCUGAGGAGAACGcAUGA | 1050 | 831 |
| AD-26149 | ccucAGAuGGuGucuGcuA | 392 | uAGcAGAcACcAUCUGAGG | 1051 | 842 |
| AD-26150 | cucAGAuGGuGucuGcuAu | 393 | AuAGcAGAcACcAUCUGAG | 1052 | 843 |
| AD-26151 | GuGucuGcuAuuGuAcGuA | 394 | uACGuAcAAuAGcAGAcAC | 1053 | 851 |
| AD-26152 | cuGcuAuuGuAcGuAccAu | 395 | AUGGuACGuAcAAuAGcAG | 1054 | 855 |
| AD-26153 | uuGuAcGuAccAuGcAGAA | 396 | UUcUGcAUGGuACGuAcAA | 1055 | 861 |
| AD-26154 | uGuAcGuAccAuGcAGAAu | 397 | AUUCUGcAUGGuACGuAcA | 1056 | 862 |
| AD-26155 | cGuAccAuGcAGAAuAcAA | 398 | UUGuAUUCUGcAUGGuACG | 1057 | 866 |
| AD-26156 | cAuGcAGAAuAcAAAuGAu | 399 | AUcAUUUGuAUUCUGcAUG | 1058 | 871 |
| AD-26157 | GcAGAAuAcAAAuGAuGuA | 400 | uAcAUcAUUUGuAUUCUGC | 1059 | 874 |
| AD-26158 | GAAuAcAAAuGAuGuAGAA | 401 | UUCuAcAUcAUUUGuAUUC | 1060 | 877 |
| AD-26159 | GAuGuAGAAAcAGcucGuu | 402 | AACGAGCUGUUUCuAcAUC | 1061 | 887 |
| AD-26160 | GuuGuAccGcuGGGAccuu | 403 | AAGGUCCcAGCGGuAcAAC | 1062 | 903 |
| AD-26161 | uAccGcuGGGAccuuGcAu | 404 | AUGcAAGGUCCcAGCGGuA | 1063 | 907 |
| AD-26162 | ccGcuGGGAccuuGcAuAA | 405 | UuAUGcAAGGUCCcAGCGG | 1064 | 909 |
| AD-26163 | uGGGAccuuGcAuAAccuu | 406 | AAGGUuAUGcAAGGUCCcA | 1065 | 913 |
| AD-26164 | GGGAccuuGcAuAAccuuu | 407 | AAAGGUuAUGcAAGGUCCC | 1066 | 914 |
| AD-26165 | cuuGcAuAAccuuucccAu | 408 | AUGGGAAAGGUuAUGcAAG | 1067 | 919 |
| AD-26166 | ucuuuAAGucuGGAGGcAu | 409 | AUGCCUCcAGACUuAAAGA | 1068 | 960 |
| AD-26167 | GcAuuccuGcccuGGuGAA | 410 | UUcACcAGGGcAGGAAUGC | 1069 | 975 |
| AD-26168 | cAuuccuGcccuGGuGAAA | 411 | UUUcACcAGGGcAGGAAUG | 1070 | 976 |
| AD-26169 | AuuccuGcccuGGuGAAAA | 412 | UUUUcACcAGGGcAGGAAU | 1071 | 977 |
| AD-26170 | uuccuGcccuGGuGAAAAu | 413 | AUUUUcACcAGGGcAGGAA | 1072 | 978 |
| AD-26171 | uGccuGcGuGAAAAuGccu | 414 | AAGcAUUUUcAccAGGGcA | 1073 | 982 |
| AD-26172 | cuGGuGAAAAuGcuuGGuu | 415 | AACcAAGcAUUUUcACcAG | 1074 | 986 |
| AD-26173 | GcuuGGuucAccAGuGGAu | 416 | AUCcACUGGUGAACcAAGC | 1075 | 997 |
| AD-26174 | cuuGGuucAccAGuGGAuu | 417 | AAUCcACUGGUGAACcAAG | 1076 | 998 |
| AD-26175 | uGcGuGAGcAGGGuGccAu | 418 | AUGGcACCCUGCUcACGcA | 1077 | 1848 |
| AD-26176 | GcGuGAGcAGGGuGccAuu | 419 | AAUGGcACCCUGCUcACGC | 1078 | 1849 |
| AD-26177 | cAccAGuGGAuucuGuGuu | 420 | AAcAcAGAAUCcACUGGUG | 1079 | 1005 |
| AD-26178 | cAGuGGAuucuGuGuuGuu | 421 | AAcAAcAcAGAAUCcACUG | 1080 | 1008 |
| AD-26179 | AGuGGAuucuGuGuuGuuu | 422 | AAAcAAcAcAGAAUCcACU | 1081 | 1009 |
| AD-26180 | GuGGAuucuGuGuuGuuuu | 423 | AAAAcAAcAcAGAAUCcAC | 1082 | 1010 |
| AD-26181 | uGGAuucuGuGuuGuuuuA | 424 | uAAAAcAAcAcAGAAUCcA | 1083 | 1011 |
| AD-26182 | GGAuucuGuGuuGuuuuAu | 425 | AuAAAAcAAcAcAGAAUCC | 1084 | 1012 |
| AD-26183 | uGuGuuGuuuuAuGccAuu | 426 | AAUGGcAuAAAAcAAcAcA | 1085 | 1018 |
| AD-26184 | GGGuGGGAcAcAGcAGcAA | 427 | UUGCUGCUGUGUCCcACCC | 1086 | 1927 |

TABLE 3-continued

Beta-Catenin RNAi agents: Example Modified Sequences

| | | | | | | |
|---|---|---|---|---|---|---|
| AD-26185 | GuGuuGuuuuAuGccAuuA | 428 | uAAUGGcAuAAAAcAAcAC | 1087 | 1019 |
| AD-26186 | uuGuuuuAuGccAuuAcAA | 6495 | UUGuAAUGGcAuAAAAcAA | 1088 | 1022 |
| AD-26187 | ccAuuAcAAcucuccAcAA | 6496 | UUGUGGAGAGUUGuAAUGG | 1089 | 1032 |
| AD-26188 | uAcAcucuccAcAAccuu | 431 | AAGGUUGUGGAGAGUUGuA | 1090 | 1036 |
| AD-26189 | AcAAcucuccAcAAccuuu | 432 | AAAGGUUGUGGAGAGUUGU | 1091 | 1037 |
| AD-26190 | cAAcucuccAcAAccuuuu | 433 | AAAAGGUUGUGGAGAGUUG | 1092 | 1038 |
| AD-26191 | AAcucuccAcAAccuuuuA | 434 | uAAAAGGUUGUGGAGAGUU | 1093 | 1039 |
| AD-26192 | AcucuccAcAAccuuuuAu | 435 | AuAAAAGGUUGUGGAGAGU | 1094 | 1040 |
| AD-26193 | cucuccAcAAccuuuuAuu | 436 | AAuAAAAGGUUGUGGAGAG | 1095 | 1041 |
| AD-26194 | ucuccAcAAccuuuuAuuA | 437 | uAAuAAAAGGUUGUGGAGA | 1096 | 1042 |
| AD-26195 | cAAccuuuuAuuAcAucAA | 438 | UUGAUGuAAuAAAAGGUUG | 1097 | 1048 |
| AD-26196 | ccuuuuAuuAcAucAAGAA | 439 | UUCUUGAUGuAAuAAAAGG | 1098 | 1051 |
| AD-26197 | uuAcAucAAGAAGGAGcuA | 440 | uAGCUCCUUCUUGAUGuAA | 1099 | 1058 |
| AD-26198 | uAcAucAAGAAGGAGcuAA | 441 | UuAGCUCCUUCUUGAUGuA | 1100 | 1059 |
| AD-26199 | cAucAAGAAGGAGcuAAAA | 442 | UUUuAGCUCCUUCUUGAUG | 1101 | 1061 |
| AD-26200 | AucAAGAAGGAGcuAAAAu | 443 | AUUUuAGCUCCUUCUUGAU | 1102 | 1062 |
| AD-26201 | GcuAAAAuGGcAGuGcGuu | 444 | AACGcACUGCcAUUUuAGC | 1103 | 1073 |
| AD-26202 | uAAAAuGGcAGuGcGuuuA | 445 | uAAACGcACUGCcAUUUuA | 1104 | 1075 |
| AD-26203 | AAAuGGuuGccuuGcucAA | 446 | UUGAGcAAGGcAACcAUUU | 1105 | 1110 |
| AD-26204 | GccuGuuccccuGAGGGuA | 447 | uACCCUcAGGGGAAcAGGC | 1106 | 206 |
| AD-26205 | uGGuuGccuuGcucAAcAA | 448 | UUGUUGAGcAAGGcAACcA | 1107 | 1113 |
| AD-26206 | GGuuGccuuGcucAAcAAA | 449 | UUUGUUGAGcAAGGcAACC | 1108 | 1114 |
| AD-26207 | GuuGccuuGcucAAcAAAA | 450 | UUUUGUUGAGcAAGGcAAC | 1109 | 1115 |
| AD-26208 | GccuuGcucAAcAAAAcAA | 451 | UUGUUUUGUUGAGcAAGGC | 1110 | 1118 |
| AD-26209 | ccuuGcucAAcAAAAcAAA | 452 | UUUGUUUUGUUGAGcAAGG | 1111 | 1119 |
| AD-26210 | GuuAAAuucuuGGcuAuuA | 453 | uAAuAGCcAAGAAUUuAAC | 1112 | 1139 |
| AD-26211 | uAuuAcGAcAGAcuGccuu | 454 | AAGGcAGUCUGCGuAuuA | 1113 | 1153 |
| AD-26212 | AuGGcAAccAAGAAAGcAA | 455 | UUGCUUUCUUGGUUGCcAU | 1114 | 1185 |
| AD-26213 | AGuGGuGGAccccAAGcuu | 456 | AAGCUUGGGGUCcACcACU | 1115 | 1220 |
| AD-26214 | GuGGuGGAccccAAGcuuu | 457 | AAAGCUUGGGGUCcACcAC | 1116 | 1221 |
| AD-26215 | uGGuGGAccccAAGcuuuA | 458 | uAAAGCUUGGGGUCcACcA | 1117 | 1222 |
| AD-26216 | uGGAccccAAGcuuuAGuA | 459 | uACuAAAGCUUGGGGUCcA | 1118 | 1225 |
| AD-26217 | GGAccccAAGcuuuAGuAA | 460 | UuAcuAAAGCUUGGGGUCC | 1119 | 1226 |
| AD-26218 | GAccccAAGcuuuAGuAAA | 461 | UUuACuAAAGCUUGGGGUC | 1120 | 1227 |
| AD-26651 | AccccAAGcuuuAGuAAAu | 462 | AUUuACuAAAGCUUGGGGU | 1121 | 1228 |
| AD-26652 | ccccAAGcuuuAGuAAAuA | 463 | uAUUuACuAAAGCUUGGGG | 1122 | 1229 |
| AD-26653 | cccAAGcuuuAGuAAAuAu | 464 | AuAUUuACuAAAGCUUGGG | 1123 | 1230 |
| AD-26654 | ccAAGcuuuAGuAAAuAuA | 465 | uAuAUUuACuAAAGCUUGG | 1124 | 1231 |
| AD-26655 | uAAAuAuAAuGAGGAccuA | 466 | uAGGUCCUcAUuAuAUUuA | 1125 | 1242 |
| AD-26656 | AAAuAuAAuGAGGAccuAu | 467 | AuAGGUCCUcAUuAuAUUU | 1126 | 1243 |
| AD-26657 | AAuAuAAuGAGGAccuAuA | 468 | uAAGGUCCUcAUuAuAUU | 1127 | 1244 |
| AD-26658 | AuAuGAGGAccuAuAcuu | 469 | AAGuAuAGGUCCUcAUuAU | 1128 | 1247 |
| AD-26659 | AAAcuAcuGuGGAccAcAA | 470 | UUGUGGUCcAcAGuAGUUU | 1129 | 1271 |
| AD-26660 | ccAcAAGcAGAGuGcuGAA | 471 | UUcAGcACUCUGCUUGUGG | 1130 | 1284 |
| AD-26661 | cAGAGuGcuGAAGGuGcuA | 472 | uAGcACCUUcAGcACUCUG | 1131 | 1291 |
| AD-26662 | AGAGuGcuGAAGGuGcuAu | 473 | AuAGcACCUUcAGcACUCU | 1132 | 1292 |
| AD-26663 | AuuGuAGAAGcuGGuGGAA | 474 | UUCcAccAGCUUCuAcAAU | 1133 | 1337 |
| AD-26664 | uuGuAGAAGcuGGuGGAAu | 475 | AUUCcAccAGCUUCuAcAA | 1134 | 1338 |
| AD-26665 | GcuGGuGGAAuGcAAGcuu | 476 | AAGCUUGcAUUCcAccAGC | 1135 | 1346 |
| AD-26666 | cuGGuGGAAuGcAAGcuuu | 477 | AAAGCUUGcAUUCcAccAG | 1136 | 1347 |
| AD-26667 | AGGAcuucAccuGAcAGAu | 478 | AUCUGUcAGGUGAAGUCCU | 1137 | 1366 |
| AD-26668 | cuucAccuGAcAGAuccAA | 479 | UUGGAUCUGUcAGGUGAAG | 1138 | 1370 |
| AD-26669 | ccuGAcAGAuccAAGucAA | 480 | UUGACUUGGAUCUGUcAGG | 1139 | 1375 |
| AD-26670 | AGAuccAAGucAAcGucuu | 481 | AAGACGUUGACUUGGAUCU | 1140 | 1381 |
| AD-26671 | uccAAGucAAcGucuuGuu | 482 | AAcAAGACGUUGACUUGGA | 1141 | 1384 |
| AD-26672 | ucuuGuucAGAAcuGucuu | 483 | AAGAcAGUUCUGAAcAAGA | 1142 | 1396 |
| AD-26673 | cuuGuucAGAAcuGucuuu | 484 | AAAGAcAGUUCUGAAcAAG | 1143 | 1397 |
| AD-26674 | GucuuuGGAcucucAGGAA | 485 | UUCCUGAGAGUCcAAAGAC | 1144 | 1410 |
| AD-26675 | ucuuuGGAcucucAGGAAu | 486 | AUUCCUGAGAGUCcAAAGA | 1145 | 1411 |
| AD-26676 | uuGGAcucucAGGAAucuu | 487 | AAGAUUCCUGAGAGUCcAA | 1146 | 1414 |
| AD-26677 | uGcccAGGGAGAAcccuu | 488 | AAGGGGUUCUCCCUGGGcA | 1147 | 2371 |
| AD-26678 | uGGAcucucAGGAAucuuu | 489 | AAAGAUUCCUGAGAGUCcA | 1148 | 1415 |
| AD-26679 | ucucAGGAAucuuucAGAu | 490 | AUCUGAAAGAUUCCUGAGA | 1149 | 1420 |
| AD-26680 | AAucuuucAGAuGcuGcAA | 491 | UUGcAGcAUCUGAAAGAUU | 1150 | 1427 |
| AD-26681 | cuuucAGAuGcuGcAAcuu | 492 | uAGUUGcAGcAUCUGAAAG | 1151 | 1430 |
| AD-26682 | uucAGAuGcuGcAAcuAAA | 493 | UUuAGUUGcAGcAUCUGAA | 1152 | 1432 |
| AD-26683 | uGcuGcAcuAAAcAGGAA | 494 | UUCCUGUuAGUUGcAGcA | 1153 | 1438 |
| AD-26684 | uAAAcAGGAAGGGAuGGAA | 495 | UUCcAUCCCUUCCUGUuA | 1154 | 1447 |
| AD-26685 | AGGGAuGGAAGGucuccuu | 496 | AAGGAGACCUUCcAUCCCU | 1155 | 1456 |
| AD-26686 | AGGucuccuuGGGAcucuu | 497 | AAGAGUCCcAAGGAGACCU | 1156 | 1465 |
| AD-26687 | ucuccuuGGGAcucuuGuu | 498 | AAcAAGAGUCCcAAGGAGA | 1157 | 1468 |
| AD-26688 | uGGGAcucuuGuucAGcuu | 499 | AAGCUGAAcAAGAGUCCA | 1158 | 1474 |
| AD-26689 | cuuGuucAGcuucuGGGuu | 500 | AACCcAGAAGCUGAAcAAG | 1159 | 1481 |
| AD-26690 | ucAGcuucuGGGuucAGAu | 501 | AUCUGAACCcAGAAGCUGA | 1160 | 1486 |
| AD-26691 | GcuucuGGGuucAGAuGAu | 502 | AUcAUCUGAACCcAGAAGC | 1161 | 1489 |
| AD-26692 | cuucuGGGuucAGAuGAuA | 503 | uAUcAUCUGAACCcAGAAG | 1162 | 1490 |
| AD-26693 | GGccAGGAuGccuuGGGuA | 504 | uACCcAAGGcAUCCUGGCC | 1163 | 2441 |
| AD-26694 | uucuGGGuucAGAuGAuAu | 505 | AuAUcAUCUGAACCcAGAA | 1164 | 1491 |

TABLE 3-continued

Beta-Catenin RNAi agents: Example Modified Sequences

| | | | | | |
|---|---|---|---|---|---|
| AD-26695 | cuGGGuucAGAuGAuAuAA | 506 | UuAuAUcAUCUGAACCcAG | 1165 | 1493 |
| AD-26696 | uGGGuucAGAuGAuAuAAA | 507 | UUuAuAUcAUCUGAACCcA | 1166 | 1494 |
| AD-26697 | GucAccuGuGcAGcuGgAA | 508 | UUCcAGCUGcAcAGGUGAC | 1167 | 1517 |
| AD-26698 | ucAccuGuGcAGcuGGAAu | 509 | AUUCcAGCUGcAcAGGUGA | 1168 | 1518 |
| AD-26699 | cAccuGuGcAGcuGGAAuu | 510 | AAUUCcAGCUGcAcAGGUG | 1169 | 1519 |
| AD-26700 | cuGuGcAGcuGGAAuucuu | 511 | AAGAAUUCcAGCUGcAcAG | 1170 | 1522 |
| AD-26701 | uGuGcAGcuGGAAuucuuu | 512 | AAAGAAUUCcAGCUGcAcA | 1171 | 1523 |
| AD-26702 | GcAGcuGGAAuucuuucuA | 513 | uAGAAAGAAUUCcAGCUGC | 1172 | 1526 |
| AD-26703 | cAGcuGGAAuucuuucuAA | 514 | UuAGAAAGAAUUCcAGCUG | 1173 | 1527 |
| AD-26704 | uuucuAAccucAcuuGcAA | 515 | UUGcAAGUGAGGUuAGAAA | 1174 | 1539 |
| AD-26705 | uucuAAccucAcuuGcAAu | 516 | AUUGcAAGUGAGGUuAGAA | 1175 | 1540 |
| AD-26706 | AccucAcuuGcAAuAAuuA | 517 | uAAUuAUUGcAAGUGAGGU | 1176 | 1545 |
| AD-26707 | ccucAcuuGcAAuAAuuAu | 518 | AuAAUuAUUGcAAGUGAGG | 1177 | 1546 |
| AD-26708 | cucAcuuGcAAuAAuuAuA | 519 | uAuAAUuAUUGcAAGUGAG | 1178 | 1547 |
| AD-26709 | GucuGccAAGuGGGuGGuA | 520 | uACcACCcACUUGGcAGAC | 1179 | 1580 |
| AD-26710 | ucuGccAAGuGGGuGGuAu | 521 | AuACcACCcACUUGGcAGA | 1180 | 1581 |
| AD-26711 | GGGuGGuAuAGAGGcucuu | 522 | AAGAGCCUCuAuAcCACCC | 1181 | 1591 |
| AD-26712 | AuAGAGGcucuuGuGcGuA | 523 | uACGcAcAAGAGCCUCuAU | 1182 | 1598 |
| AD-26713 | ucuuGuGcGuAcuGuccuu | 524 | AAGGAcAGuACGcAcAAGA | 1183 | 1606 |
| AD-26714 | cuGGuGAcAGGGAAGAcAu | 525 | AUGUCUUCCCUGUcACcAG | 1184 | 1629 |
| AD-26715 | AcAucAcuGAGccuGccAu | 526 | AUGGcAGGCUcAGUGAUGU | 1185 | 1644 |
| AD-26716 | GccuGccAucuGuGcucuu | 527 | AAGAGcAcAGAUGGcAGGC | 1186 | 1654 |
| AD-26717 | ucuGAccAGccGAcAccAA | 528 | UUGGGUGUCGGCUGGUcAGA | 1187 | 1678 |
| AD-26718 | GAccAGccGAcAccAAGAA | 529 | UUCUUGGUGUCGGCUGGUC | 1188 | 1681 |
| AD-26719 | GAcAccAAGAAGcAGAGAu | 530 | AUCUCUGCUUCUUGGUGUC | 1189 | 1689 |
| AD-26720 | AGcAGAGAuGGcccAGAAu | 531 | AUUCUGGGCcAUCUCUGCU | 1190 | 1699 |
| AD-26721 | GAuGGcccAGAAuGcAGuu | 532 | AACUGcAUUCUGGGCcAUC | 1191 | 1705 |
| AD-26722 | ccAGAAuGcAGuucGccuu | 533 | AAGGCGAACUGcAUUCUGG | 1192 | 1711 |
| AD-26723 | AuGcAGuucGccuucAcuA | 534 | uAGUGAAGGCGAACUGcAU | 1193 | 1716 |
| AD-26724 | uGcAGuucGccuucAcuAu | 535 | AuAGUGAAGGCGAACUGcA | 1194 | 1717 |
| AD-26725 | ucGccuucAcuAuGGAcuA | 536 | uAGUCcAuAGUGAAGGCGA | 1195 | 1723 |
| AD-26726 | ucAcuAuGGAcuAccAGuu | 537 | AACUGGuAGUCcAuAGUGA | 1196 | 1729 |
| AD-26727 | uGGAcuAccAGuuGuGGuu | 538 | AACcAcAACUGGuAGUCcA | 1197 | 1735 |
| AD-26728 | GGAcuAccAGuuGuGGuuA | 539 | uAACcAcAACUGGuAGUCC | 1198 | 1736 |
| AD-26729 | GAcuAccAGuuGuGGuuAA | 540 | UuAACcAcAACUGGuAGUC | 1199 | 1737 |
| AD-26730 | cAGuuGuGGuuAAGcucuu | 541 | AAGAGCUuAACcAcAACUG | 1200 | 1743 |
| AD-26731 | AGuuGuGGuuAAGcucuuA | 542 | uAAGAGCUuAACcAcAACU | 1201 | 1744 |
| AD-26732 | AAGcucuuAcAcccAccAu | 543 | AUGGUGGGUGuAAGAGCUU | 1202 | 1754 |
| AD-26733 | cAucccAcuGGccucuGAu | 544 | AUcAGAGGCcAGUGGGAUG | 1203 | 1770 |
| AD-26734 | AucccAcuGGccucuGAuA | 545 | uAUcAGAGGCcAGUGGGAU | 1204 | 1771 |
| AD-26735 | ucccAcuGGccucuGAuAA | 546 | UuAUcAGAGGCcAGUGGGA | 1205 | 1772 |
| AD-26736 | uGGccucuGAuAAAGGcuA | 547 | uAGCCUUuAUcAGAGGCcA | 1206 | 1778 |
| AD-26737 | ucuGAuAAAGGcuAcuGuu | 548 | AAcAGuAGCCUUuAUcAGA | 1207 | 1783 |
| AD-26738 | AuAAAGGcuAcuGuuGGAu | 549 | AUCcAAcAGuAGCCUUuAU | 1208 | 1787 |
| AD-26739 | GGcuAcuGuuGGAuuGAuu | 550 | AAUcAAUCcAAcAGuAGCC | 1209 | 1792 |
| AD-26740 | uGuuGGAuuGAuucGAAAu | 551 | AUUUCGAAUcAAUCcAAcA | 1210 | 1798 |
| AD-26741 | uGccAuuccAcGAcuAGuu | 552 | AACuAGUCGUGGAAUGGcA | 1211 | 1861 |
| AD-26742 | uuccAcGAcuAGuucAGuu | 553 | AACUGAACuAGUCGUGGAA | 1212 | 1866 |
| AD-26743 | AcGAcuAGuucAGuuGcuu | 554 | AAGcAACUGAACuAGUCGU | 1213 | 1870 |
| AD-26744 | AcuAGuucAGuuGcuuGuu | 555 | AAcAAGcAACUGAACuAGU | 1214 | 1873 |
| AD-26745 | GuuGcuuGuuGuGcAcAu | 556 | AUGUGcACGAAcAAGcAAC | 1215 | 1882 |
| AD-26746 | uGuuGcAcAucAGGAu | 557 | AUCCUGAUGUGcACGAAC | 1216 | 1888 |
| AD-26747 | GuucGuGcAcAucAGGAuA | 558 | uAUCCUGAUGUGcACGAAC | 1217 | 1889 |
| AD-26748 | GGuGGGAcAcAGcAGcAAu | 559 | AUUGCUGCUGUGUCCcACC | 1218 | 1928 |
| AD-26749 | GuGGGAcAcAGcAGcAAuu | 560 | AAUUGCUGCUGUGUCCcAC | 1219 | 1929 |
| AD-26750 | uGGGAcAcAGcAGcAAuuu | 561 | AAAUUGCUGCUGUGUCCcA | 1220 | 1930 |
| AD-26751 | GGGGuccGcAuGGAAGAAA | 562 | UUUCUUCcAUGCGGACCCC | 1221 | 1955 |
| AD-26752 | GGGuccGcAuGGAAGAAAu | 563 | AUUUCUUCcAUGCGGACCC | 1222 | 1956 |
| AD-26753 | ucAcAuccuAGcucGGGAu | 564 | AUCCCGAGCuAGGAUGUGA | 1223 | 1999 |
| AD-26754 | cAuccuAGcucGGGAuGcAA | 565 | AAcAUCCCGAGCuAGGAUG | 1224 | 2002 |
| AD-26755 | uAGcucGGGAuGuucAcAA | 566 | UUGUGAAcAUCCCGAGCuA | 1225 | 2007 |
| AD-26756 | GGGAuGuucAcAAccGAAu | 567 | AUUCGGUUGUGAAcAUCCC | 1226 | 2013 |
| AD-26757 | GGAuGuucAcAAccGAAuu | 568 | AAUUCGGUUGUGAAcAUCC | 1227 | 2014 |
| AD-26758 | cAGAGGAcuAAAAuAccAuu | 569 | AAUGGuAUUuAGUCCUCUG | 1228 | 2038 |
| AD-26759 | GGAcuAAAAuAccAuuGuu | 570 | AUGGAAUGGuAUUuAGUCC | 1229 | 2042 |
| AD-26760 | uAAAAuAccAuuccAuuGuu | 571 | AAcAAUGGAAUGGuAUUuA | 1230 | 2046 |
| AD-26761 | AAAAuAccAuuccAuuGuuu | 572 | AAAcAAUGGAAUGGuAUUU | 1231 | 2047 |
| AD-26762 | AuuGuuuGuGcAGcuGcuu | 573 | AAGcAGCUGcAcAAAcAAU | 1232 | 2059 |
| AD-26763 | uuGuuuGuGcAGcuGcuuu | 574 | AAAGcAGCUGcAcAAAcAA | 1233 | 2060 |
| AD-26764 | uGuuuGuGcAGcuGcuuuA | 575 | uAAAGcAGCUGcAcAAAcA | 1234 | 2061 |
| AD-26765 | GuuuGuGcAGcuGcuuuAu | 576 | AuAAAGcAGCUGcAcAAAC | 1235 | 2062 |
| AD-26766 | uuuGuGcAGcuGcuuuAuu | 577 | AAuAAAGcAGCUGcAcAAA | 1236 | 2063 |
| AD-26767 | AGcuGuuuAuucucccAuu | 578 | AUGGGAGAAuAAAcAGCU | 1237 | 2070 |
| AD-26768 | GcuGuuuAuucucccAuuu | 579 | AAUGGGAGAAuAAAGcAGC | 1238 | 2071 |
| AD-26769 | uuuAuucucccAuuGAAAA | 580 | UUUUcAUGGGAGAAuAAA | 1239 | 2076 |
| AD-26770 | AuucucccAuuGAAAAcAu | 581 | AUGUUUUcAUGGGAGAAU | 1240 | 2079 |
| AD-26771 | ucccAuuGAAAAcAuccAA | 582 | UUGGAUGUUUUcAUGGGA | 1241 | 2083 |
| AD-26772 | uGcAGGGGuccucuGuGAA | 583 | UUcAcAGAGGACCCCUGcA | 1242 | 2110 |

TABLE 3-continued

Beta-Catenin RNAi agents: Example Modified Sequences

| | | | | | |
|---|---|---|---|---|---|
| AD-26773 | AcuuGcucAGGAcAAGGAA | 584 | UUCCUUGUCCUGAGcAAGU | 1243 | 2128 |
| AD-26774 | cAGcuccucuGAcAGAGuu | 585 | AACUCUGUcAGAGGAGCUG | 1244 | 2178 |
| AD-26775 | AGcuccucuGAcAGAGuuA | 586 | uAACUCUGUcAGAGGAGCU | 1245 | 2179 |
| AD-26776 | uccucuGAcAGAGuuAcuu | 587 | AAGuAACUCUGUcAGAGGA | 1246 | 2182 |
| AD-26777 | AcAGAGuuAcuuAcucuA | 588 | uAGAGUGAAGuAACUCUGU | 1247 | 2189 |
| AD-26778 | AGuuAcuuAcucuAGGAA | 589 | UUCCuAGAGUGAAGuAACU | 1248 | 2193 |
| AD-26779 | GuuAcuuAcucuAGGAAu | 590 | AUUCCuAGAGUGAAGuAAC | 1249 | 2194 |
| AD-26780 | AcuucAcucuAGGAAuGAA | 591 | UUcAUUCCuAGAGUGAAGU | 1250 | 2197 |
| AD-26781 | GcuGcuGuuuuGuuccGAA | 592 | UUCGGAAcAAAAcAGcAGC | 1251 | 2234 |
| AD-26782 | cuGcuGuuuuGuuccGAAu | 593 | AUUCGGAAcAAAAcAGCAG | 1252 | 2235 |
| AD-26783 | GucuGAGGAcAAGccAcAA | 594 | UUGUGGCUUGUCCUcAGAC | 1253 | 2254 |
| AD-26784 | uGAGGAcAAGccAcAAGAu | 595 | AUCUUGUGGCUUGUCCUcA | 1254 | 2257 |
| AD-26785 | AcAAGccAcAAGAuuAcAA | 596 | UUGuAAUCUUGUGGCUUGU | 1255 | 2262 |
| AD-26786 | AGccAcAAGAuuAcAAGAA | 597 | UUCUUUGuAAUCUUGUGGCU | 1256 | 2265 |
| AD-26787 | AGAuuAcAAGAAAcGGcuu | 598 | AAGCCGUUUCUUGuAAUCU | 1257 | 2272 |
| AD-26788 | cAAGAAAcGGcuuucAGAA | 599 | AACUGAAAGCCGUUUCUUG | 1258 | 2278 |
| AD-26789 | AGcuGAccAGcucucucuu | 600 | AAGAGAGAGCUGGUcAGCU | 1259 | 2298 |
| AD-26790 | AccAGcucucucuucAGAA | 601 | UUCUGAAGAGAGAGCUGGU | 1260 | 2303 |
| AD-26791 | uAuuGGuGcccAGGGAGAA | 602 | UUCUCCCUGGGcAccAAuA | 1261 | 2365 |
| AD-26792 | cAGGGAGAAcccuuGGAu | 603 | AUCcAAGGGGUUCUCCCUG | 1262 | 2375 |
| AD-26793 | AGGGAGAAcccuuGGAuA | 604 | uAUCcAAGGGGUUCUCCCU | 1263 | 2376 |
| AD-26794 | ccuuGGAuAucGccAGGAu | 605 | AUCCUGGCGAuAUCcAAGG | 1264 | 2386 |
| AD-26795 | uAucGccAGGAuGAuccuA | 606 | uAGGAUcAUCCUGGCGAuA | 1265 | 2393 |
| AD-26796 | GccAGGAuGAuccuAGcuA | 607 | uAGCuAGGAUcAUCCUGGC | 1266 | 2397 |
| AD-26797 | ccAGGAuGAuccuAGcuAu | 608 | AuAGCuAGGAUcAUCCUGG | 1267 | 2398 |
| AD-26798 | GAuGAuccuAGcuAucGuu | 609 | AACGAuAGCuAGGAUcAUC | 1268 | 2402 |
| AD-26799 | AuccuAGcuAucGuucuuu | 610 | AAAGAACGAuAGCuAGGAU | 1269 | 2406 |
| AD-26800 | uccuAGcuAucGuucuuuu | 611 | AAAAGAACGAuAGCuAGGA | 1270 | 2407 |
| AD-26801 | ucuuuucAcucuGGuGGAu | 612 | AUCcACcAGAGUGAAAAGA | 1271 | 2420 |
| AD-26802 | cuuuucAcucuGGuGGAuA | 613 | uAUCcACcAGAGUGAAAAG | 1272 | 2421 |
| AD-26803 | uuuucAcucuGGuGGAuAu | 614 | AuAUCcAcAGAGUGAAAA | 1273 | 2422 |
| AD-26804 | uGGuGGAuAuGGccAGGAA | 615 | AUCCUGGCcAuAUCcACcA | 1274 | 2431 |
| AD-26805 | GAuGGccAGGAuGccuu | 616 | AAGGcAUCCUGGCcAuAUC | 1275 | 2436 |
| AD-26806 | ccuuGGGuAuGGAccccAu | 617 | AUGGGGUCcAuACCcAAGG | 1276 | 2451 |
| AD-26807 | uGGGuAuGGAccccAuGAu | 618 | AUcAUGGGGUCcAuACCcA | 1277 | 2454 |
| AD-26808 | uuuGuAAAcuuGAuuAAcuA | 619 | uAGUuAAUcAAGUUuAcAA | 1278 | 675 |
| AD-26809 | uGuAAAcuuGAuuAAcuAu | 620 | AuAGUuAAUcAAGUUuAcA | 1279 | 676 |
| AD-26810 | AAAcuuGAuuAAcuAucAA | 621 | UUGAuAGUuAAUcAAGUUU | 1280 | 679 |
| AD-26811 | uAuGGAccccAuGAuGGAA | 622 | UUCcAUcAUGGGGUCcAuA | 1281 | 2458 |
| AD-26812 | GGAccccAuGAuGGAAcAu | 623 | AUGUUCcAUcAUGGGGUCC | 1282 | 2461 |
| AD-26813 | ccAuGAuGGAAcAuGAGAu | 624 | AUCUcAUGUUCcAUcAUGG | 1283 | 2466 |
| AD-26814 | AccAcccuGGuGcuGAcuA | 625 | uAGUcAGcAccAGGGUGGU | 1284 | 2493 |
| AD-26815 | ccAcccuGGuGcuGAcuAu | 626 | AuAGUcAGcAccAGGGUGG | 1285 | 2494 |
| AD-26816 | uGcuGAcuAuccAGuuGAu | 627 | AUcAACUGGAuAGUcAGcA | 1286 | 2503 |
| AD-26817 | AGuuGAuGGGcuGccAGAu | 628 | AUCUGGcAGCCcAUcAACU | 1287 | 2515 |
| AD-26818 | uGcccAGGAccucAuGGAu | 629 | AUCcAUGAGGUCCUGGGcA | 1288 | 2542 |
| AD-26819 | GcAAucAGcuGGccuGGuu | 630 | AACcAGGCcAGCUGAUUGC | 1289 | 2580 |
| AD-26820 | cAAucAGcuGGccuGGuuu | 631 | AAACcAGGCcAGCUGAUUG | 1290 | 2581 |
| AD-26821 | GGuuuGAuAcuGAccuGuA | 632 | uAcAGGUcAGuAUcAAACC | 1291 | 2595 |
| AD-26822 | AuAcuGAccGuAAAucAu | 633 | AUGAUUuAcAGGUcAGuAU | 1292 | 2601 |
| AD-26823 | uGAccuGuAAAucAuccuu | 634 | AAGGAUGAUUuAcAGGUcA | 1293 | 2605 |
| AD-26824 | GAccuGuAAAucAuccuuu | 635 | AAAGGAUGAUUuAcAGGUC | 1294 | 2606 |
| AD-26825 | AccuGuAAAucAuccuuuA | 636 | uAAAGGAUGAUUuAcAGGU | 1295 | 2607 |
| AD-26826 | AAuAcAAAuGAuGuAGAAA | 637 | UUUCuAcAUcAUUUGuAUU | 1296 | 878 |
| AD-26900 | uuuuAAGAuAucuGuAAu | 638 | AUuAcAGAuAUCUuAAAA | 1297 | 2745 |
| AD-26901 | uAcAGcAuuucuAAuuuu | 639 | AAAAUuAGAAAUUGCUGuA | 1298 | 2872 |
| AD-26902 | cAcuAAuucAuAAucAcuc | 640 | GAGUGAUuAUGAAUuAGUG | 1299 | 2915 |
| AD-26903 | AcuAAuucAuAAucAcucu | 641 | AGAGUGAUuAUGAAuuAGU | 1300 | 2916 |
| AD-26904 | uAAuucAuAAucAcucuAA | 642 | UuAGAGUGAUuAUGAAUuA | 1301 | 2918 |
| AD-26905 | AAuucAuAAucAcucuAAu | 643 | AUuAGAGUGAUuAUGAAUU | 1302 | 2919 |
| AD-26906 | AAuuGAAucuGAAuAAAG | 644 | CUUuAUUcAGAUuAcAAUU | 1303 | 2939 |
| AD-26907 | uuuGuAuAAAAuAGAcAAA | 645 | UUUGUCuAUUUuAuAcAAA | 1304 | 2978 |
| AD-26908 | uuGuAAAAAuAGAcAAAu | 646 | AUUUGUCuAUUUuAuAcAA | 1305 | 2979 |
| AD-26909 | uGuAAAAAuAGAcAAAuA | 647 | uAUUUGUCuAUUUuAuAcA | 1306 | 2980 |
| AD-26910 | GuAuAAAAuAGAcAAAuAG | 648 | CuAUUUGUCuAUUUuAuAC | 1307 | 2981 |
| AD-26911 | AuAAAAuAGAcAAAuAGAA | 649 | UUCuAUUUGUCuAUUUuAU | 1308 | 2983 |
| AD-26912 | uAAAAuAGAcAAAuAGAAA | 650 | UUUCuAUUUGUCuAUUUuA | 1309 | 2984 |
| AD-26913 | AAAAuAGAcAAAuAGAAAu | 651 | AUUUCuAUUUGUCuAUUU | 1310 | 2986 |
| AD-26914 | uGGGAuAuGuAuGGGuAGG | 652 | CCuACCcAuAcAuAUCCcA | 1311 | 3081 |
| AD-26915 | GGGAuAuGuAuGGGuAGGG | 653 | CCCuACCcAuAcAuAUCCC | 1312 | 3082 |
| AD-26916 | cuAuucAuAAucAcucuA | 654 | uAGAGUGAUuAUGAAuuAG | 1313 | 2917 |
| AD-26917 | AAAuAGAAAuGGuccAAu | 655 | AUUGGAccAUUUCuAUUU | 1314 | 2994 |
| AD-26918 | AAuAGAAAAuGGuccAAuu | 656 | AAUUGGACcAUUUCuAUU | 1315 | 2995 |
| AD-26919 | uuuGGAcAGuuuAccAGuu | 657 | AACUGGuAAACUGUCcAAA | 1316 | 3134 |

TABLE 3-continued

Beta-Catenin RNAi agents: Example Modified Sequences

| | | | | | |
|---|---|---|---|---|---|
| AD-26920 | AuucuuucuAAccucAcuu | 658 | AAGUGAGGUuUAGAAAGAAU | 1317 | 1535 |
| AD-26921 | uGGAuuGAuucGAAAucuu | 659 | AAGAUUUCGAAUcAAUCcA | 1318 | 1801 |
| Set1 254 A 22 S26 | ccAtAcAActGttttGAAA | 6141 | TTTcAAAAcAGTTGtATGG | 6309 | 236 |
| Set1 703 A 22 S26 | GAttAActAtcAAGAtGAt | 6142 | ATcATCTTGAtAGTtAATC | 6310 | 685 |
| Set1 709 A 22 S26 | ctAtcAAGAtGAtGcAGAA | 6143 | TTCTGcATCATCTTGAtAG | 6311 | 691 |
| Set1 895 A 22 S26 | GAAtAcAAAtGAtGtAGAA | 6144 | TTCtAcATcATTTGtATTC | 6312 | 877 |
| Set1 1816 A 22 S26 | tGttGGAttGAttcGAAAt | 6145 | ATTTCGAAtcAATCcAAcA | 6313 | 1798 |
| Set1 1974 A 22 S26 | GGGtccGcAtGGAAGAAAt | 6146 | ATTTCTTCcATGCGGACCC | 6314 | 1956 |
| Set1 2425 A 22 S26 | tcctAGctAtcGttcttttt | 6147 | AAAAGAACGAtAGCtAGGA | 6315 | 2407 |
| Set1 3146 A 22 S26 | AAGtGAAGAAtGcAcAAGA | 6148 | TCTTGTGcATTCTTcACTT | 6316 | 3128 |
| Set1 889 A 22 S26 | cAtGcAGAAtAcAAAtGAt | 6149 | ATcATTTGtATTCTGcATG | 6317 | 871 |
| Set1 1814 A 22 S26 | ActGttGGAttGAttcGAA | 6150 | TTCGAAtcAATCcAAcAGT | 6318 | 1796 |
| Set1 1245 A 22 S26 | GAccccAAGctttAGtAAA | 6151 | TTtACtAAAGCTTGGGGTC | 6319 | 1227 |
| Set1 3196 A 22 S26 | AGccttGcttGttAAAttt | 6152 | AAATTtAAcAAGcAAGGCT | 6320 | 3178 |
| Set1 1450 A 22 S26 | ttcAGAtGctGcAActAAA | 6153 | TTtAGTTGcAGcATCTGAA | 6321 | 1432 |
| Set1 3169 A 22 S26 | AtcAcAAGAtGGAAttttAt | 6154 | AtAAATTCcATCTTGTGAT | 6322 | 3151 |
| Set1 3477 A 22 S26 | AAtAGAAAAtGGtccAAtt | 6155 | AATTGGAccATTTTCtATT | 6323 | 3459 |
| Set1 865 A 22 S26 | GAtGGtGtctGctAttGtA | 6156 | tAcAAtAGcAGAcACcATC | 6324 | 847 |
| Set1 1249 A 22 S26 | ccAAGctttAGtAAAtAtA | 6157 | tAtATTtACtAAAGCTTGG | 6325 | 1231 |
| Set1 1250 A 22 S26 | cAAGctttAGtAAAtAtAA | 6158 | TtAtATTtACtAAAGCTTG | 6326 | 1232 |
| Set1 2202 A 22 S26 | ctctGAcAGAGttActtcA | 6159 | TGAAGtAAcTcTGTcAGAG | 6327 | 2184 |
| Set1 1545 A 22 S26 | cAGctGGAAttctttctAA | 6160 | TtAGAAAGAATTCcAGCTG | 6328 | 1527 |
| Set1 1755 A 22 S26 | GActAccAGttGtGGttAA | 6161 | TtAACcAcAACTGGtAGTC | 6329 | 1737 |
| Set1 254 A 25 S27 | CCATACAACTGTTTTGAAA | 6162 | TTTCAAAACAGTTGTATGG | 6330 | 236 |
| Set1 703 A 25 S27 | GATTAACTATCAAGATGAT | 6163 | ATCATCTTGATAGTTAATC | 6331 | 685 |
| Set1 709 A 25 S27 | CTATCAAGATGATGCAGAA | 6164 | TTCTGCATCATCTTGATAG | 6332 | 691 |
| Set1 895 A 25 S27 | GAATACAAATGATGTAGAA | 6165 | TTCTACATCATTTGTATTC | 6333 | 877 |
| Set1 1816 A 25 S27 | TGTTGGATTGATTCGAAAT | 6166 | ATTTCGAATCAATCCAACA | 6334 | 1798 |
| Set1 1974 A 25 S27 | GGGTCCGCATGGAAGAAAT | 6167 | ATTTCTTCCATGCGGACCC | 6335 | 1956 |
| Set1 2425 A 25 S27 | TCCTAGCTATCGTTCTTTT | 6168 | AAAAGAACGATAGCTAGGA | 6336 | 2407 |

TABLE 3-continued

Beta-Catenin RNAi agents: Example Modified Sequences

| | | | | | |
|---|---|---|---|---|---|
| Set1 3146 A 25 S27 | AAGTGAAGAATGCACAAGA | 6169 | TCTTGTGCATTCTTCACTT | 6337 | 3128 |
| Set1 889 A 25 S27 | CATGCAGAATACAAATGAT | 6170 | ATCATTTGTATTCTGCATG | 6338 | 871 |
| Set1 1814 A 25 S27 | ACTGTTGGATTGATTCGAA | 6171 | TTCGAATCAATCCAACAGT | 6339 | 1796 |
| Set1 1245 A 25 S27 | GACCCCAAGCTTTAGTAAA | 6172 | TTTACTAAAGCTTGGGGTC | 6340 | 1227 |
| Set1 3196 A 25 S27 | AGCCTTGCTTGTTAAATTT | 6173 | AAATTTAACAAGCAAGGCT | 6341 | 3178 |
| Set1 1450 A 25 S27 | TTCAGATGCTGCAACTAAA | 6174 | TTTAGTTGCAGCATCTGAA | 6342 | 1432 |
| Set1 3169 A 25 S27 | ATCACAAGATGGAATTTAT | 6175 | ATAAATTCCATCTTGTGAT | 6343 | 3151 |
| Set1 3477 A 25 S27 | AATAGAAAATGGTCCAATT | 6176 | AATTGGACCATTTTCTATT | 6344 | 3459 |
| Set1 865 A 25 S27 | GATGGTGTCTGCTATTGTA | 6177 | TACAATAGCAGACACCATC | 6345 | 847 |
| Set1 1249 A 25 S27 | CCAAGCTTTAGTAAATATA | 6178 | TATATTTACTAAAGCTTGG | 6346 | 1231 |
| Set1 1250 A 25 S27 | CAAGCTTTAGTAAATATAA | 6179 | TTATATTTACTAAAGCTTG | 6347 | 1232 |
| Set1 2202 A 25 S27 | CTCTGACAGAGTTACTTCA | 6180 | TGAAGTAACTCTGTCAGAG | 6348 | 2184 |
| Set1 1545 A 25 S27 | CAGCTGGAATTCTTTCTAA | 6181 | TTAGAAAGAATTCCAGCTG | 6349 | 1527 |
| Set1 1755 A 25 S27 | GACTACCAGTTGTGGTTAA | 6182 | TTAACCACAACTGGTAGTC | 6350 | 1737 |
| Set1 254 A L0 V1 S26 | ccAtAcAActGttttGAAA | 6183 | TTtcAAAAcAGttGtAtGG | 6351 | 236 |
| Set1 703 A L0 V1 S26 | GAttAActAtcAAGAtGAt | 6184 | ATcAtcttGAtAGTtAAtc | 6352 | 685 |
| Set1 709 A L0 V1 S26 | ctAtcAAGAtGAtGcAGAA | 6185 | TTctGcAtcAtctTGAtAG | 6353 | 691 |
| Set1 895 A L0 V1 S26 | GAAtAcAAAtGAtGtAGAA | 6186 | TTctAcAtcAtttGtAttc | 6354 | 877 |
| Set1 1816 A L0 V1 S26 | tGttGGAttGAttcGAAAt | 6187 | ATttcGAAtcAAtCcAAcA | 6355 | 1798 |
| Set1 1974 A L0 V1 S26 | GGGtccGcAtGGAAGAAAt | 6188 | ATttcttccAtGcGGAccc | 6356 | 1956 |
| Set1 2425 A L0 V1 S26 | tcctAGctAtcGttcttt | 6189 | AAAAGAAcGAtAGCtAGGA | 6357 | 2407 |
| Set1 3146 A L0 V1 S26 | AAGtGAAGAAtGcAcAAGA | 6190 | TCttGtGcAttctTcActt | 6358 | 3128 |
| Set1 889 A L0 V1 S26 | cAtGcAGAAtAcAAAtGAt | 6191 | ATcAtttGtAttcTGcAtG | 6359 | 871 |
| Set1 1814 A L0 V1 S26 | ActGttGGAttGAttcGAA | 6192 | TTcGAAtcAAtccAAcAGt | 6360 | 1796 |

TABLE 3-continued

Beta-Catenin RNAi agents: Example Modified Sequences

| | | | | | |
|---|---|---|---|---|---|
| Set1 1245 A LO V1 S26 | GAccccAAGctttAGtAAA | 6193 | TTtActAAAGcttGGGGtc | 6361 | 1227 |
| Set1 3196 A LO V1 S26 | AGccttGcttGttAAAttt | 6194 | AAAtttAAcAAGcAAGGct | 6362 | 3178 |
| Set1 1450 A LO V1 S26 | ttcAGAtGctGcAActAAA | 6195 | TTtAGttGcAGcATctGAA | 6363 | 1432 |
| Set1 3169 A LO V1 S26 | AtcAcAAGAtGGAAtttAt | 6196 | ATAAAttccAtctTGtGAt | 6364 | 3151 |
| Set1 3477 A LO V1 S26 | AAtAGAAAAtGGtccAAtt | 6197 | AAttGGAccAtttTctAtt | 6365 | 3459 |
| Set1 865 A LO V1 S26 | GAtGGtGtctGctAttGtA | 6198 | TAcAAtAGcAGAcAccAtc | 6366 | 847 |
| Set1 1249 A LO V1 S26 | ccAAGctttAGtAAAtAtA | 6199 | TAtAtttActAAAGcttGG | 6367 | 1231 |
| Set1 1250 A LO V1 S26 | cAAGctttAGtAAAtAtAA | 6200 | TTAtAtttActAAAGcttG | 6368 | 1232 |
| Set1 2202 A LO V1 S26 | ctctGAcAGAGttActtcA | 6201 | TGAAGtAActctGTcAGAG | 6369 | 2184 |
| Set1 1545 A LO V1 S26 | cAGctGGAAttctttctAA | 6202 | TTAGAAAGAAttcCAGctG | 6370 | 1527 |
| Set1 1755 A LO V1 S26 | GActAccAGttGtGGttAA | 6203 | TTAAccAcAActGGtAGtc | 6371 | 1737 |
| Set1 254 A LO V2 S LO V1 | ccAtACAaCTGtTTtGAaa | 6204 | TTtCAAaCaGTtGTATgg | 6372 | 236 |
| Set1 703 A LO V2 S LO V1 | gaTtAACtATCaAGaTGat | 6205 | ATcATCtTGaTAgTTAAtc | 6373 | 685 |
| Set1 709 A LO V2 S LO V1 | ctAtCAAgATGaTGcAGaa | 6206 | TTcTGCaTCaTCtTGATag | 6374 | 691 |
| Set1 895 A LO V2 S LO V1 | gaAtACAaATGaTGtAGaa | 6207 | TTcTACaTCaTTtGTATtc | 6375 | 877 |
| Set1 1816 A LO V2 S LO V1 | tgTtGGAtTGaTCgAAat | 6208 | ATtTCGaATCaATCCAAca | 6376 | 1798 |
| Set1 1974 A LO V2 S LO V1 | ggGtCCGcATGgAAgAAat | 6209 | ATtTCTtCCaTGcGGACcc | 6377 | 1956 |
| Set1 2425 A LO V2 S LO V1 | tcCtAGCtATCgTTcTTtt | 6210 | AAaAGAaCGaTAgCTAGga | 6378 | 2407 |
| Set1 3146 A LO V2 S LO V1 | aaGtGAAgAATgCAcAAga | 6211 | TCtTGTgCAtTCtTCACtt | 6379 | 3128 |
| Set1 889 A LO V2 S LO V1 | caTgCAGaATAcAAaTGat | 6212 | ATcATTtGTaTTcTGCAtg | 6380 | 871 |
| Set1 1814 A LO V2 S LO V1 | acTgTTGgATTgATtCGaa | 6213 | TTcGAAtCAaTCcAACAgt | 6381 | 1796 |

TABLE 3-continued

Beta-Catenin RNAi agents: Example Modified Sequences

| | | | | | |
|---|---|---|---|---|---|
| Set1 1245 A LO V2 S LO V1 | gaCcCCAaGCTtTAgTAaa | 6214 | TTtACTaAAgCTtGGGGtc | 6382 | 1227 |
| Set1 3196 A LO V2 S LO V1 | agCcTTGcTTGtTAaATtt | 6215 | AAaTTTaACaAGcAAGGct | 6383 | 3178 |
| Set1 1450 A LO V2 S LO V1 | ttCaGATgCTGcAAcTAaa | 6216 | TTtAGTtGCaGCaTCTGaa | 6384 | 1432 |
| Set1 3169 A LO V2 S LO V1 | atCaCAAgATGgAAtTTat | 6217 | ATaAATtCCaTCtTGTGat | 6385 | 3151 |
| Set1 3477 A LO V2 S LO V1 | aaTaGAAaATGgTCcAAtt | 6218 | AAtGGaCCaTTtTCTAtt | 6386 | 3459 |
| Set1 865 A LO V2 S LO V1 | gaTgGTGtCTGcTAtTGta | 6219 | TAcAATaGCaGAcACCAtc | 6387 | 847 |
| Set1 1249 A LO V2 S LO V1 | ccAaGCTtTAGtAAaTAta | 6220 | TAtATTtACtAAaGCTTgg | 6388 | 1231 |
| Set1 1250 A LO V2 S LO V1 | caAgCTTtAGTaAAtATaa | 6221 | TTaTATtTAcTAaAGCTtg | 6389 | 1232 |
| Set1 2202 A LO V2 S LO V1 | ctCtGACaGAGtTAcTTca | 6222 | TGaAGTaACtCTgTCAGag | 6390 | 2184 |
| Set1 1545 A LO V2 S LO V1 | caGcTGGaATTcTTtCTaa | 6223 | TTaGAAaGAaTTcCAGCtg | 6391 | 1527 |
| Set1 1755 A LO V2 S LO V1 | gaCtACCaGTTgTGgTTaa | 6224 | TTaACCaCAaCTgGTAGtc | 6392 | 1737 |
| Set2 254 A LO V3 S LO V2 | ccAtACAaCTGtTTtGAaa | 6225 | TTtCAAaACaGTtGTATgg | 6393 | 236 |
| Set2 703 A LO V3 S LO V2 | gaTtAACtATCaAGaTGat | 6226 | ATcATCtTGaTAgTTAAtc | 6394 | 685 |
| Set2 709 A LO V3 S LO V2 | ctAtCAAgATGaTGcAGaa | 6227 | TTcTGCaTCaTCtTGATag | 6395 | 691 |
| Set2 895 A LO V3 S LO V2 | gaAtACAaATGaTGtAGaa | 6228 | TTcTACaTCaTTtGTATtc | 6396 | 877 |
| Set2 1816 A LO V3 S LO V2 | tgTtGGAtTGAtTCgAAat | 6229 | ATtTCGaATcAAtCCAAca | 6397 | 1798 |
| Set2 1974 A LO V3 S LO V2 | ggGtCCGcATGgAAgAAat | 6230 | ATtTCTtCCaTGcGGACcc | 6398 | 1956 |
| Set2 2425 A LO V3 S LO V2 | tcCtAGCtATCgTTcTTtt | 6231 | AAaAGAaCGaTAgCTAGga | 6399 | 2407 |
| Set2 3146 A LO V3 S LO V2 | aaGtGAAgAATgCAcAAga | 6232 | TCtTGTgCAtTCtTCACtt | 6400 | 3128 |
| Set2 889 A LO V3 S LO V2 | caTgCAGaATAcAAaTGat | 6233 | ATcATTtGTaTTcTGCAtg | 6401 | 871 |
| Set2 1814 A LO V3 S LO V2 | acTgTTGgATTgATtCGaa | 6234 | TTcGAAtCAaTCcAACAgt | 6402 | 1796 |

TABLE 3-continued

Beta-Catenin RNAi agents: Example Modified Sequences

| | | | | | |
|---|---|---|---|---|---|
| Set2 1245 A LO V3 S LO V2 | gaCcCCAaGCTtTAgTAaa | 6235 | TTtACTaAAgCTtGGGGtc | 6403 | 1227 |
| Set2 3196 A LO V3 S LO V2 | agCcTTGcTTGtTAaATtt | 6236 | AAaTTTaACaAGcAAGGct | 6404 | 3178 |
| Set2 1450 A LO V3 S LO V2 | ttCaGATgCTGcAAcTAaa | 6237 | TTtAGTtGCaGCaTCTGaa | 6405 | 1432 |
| Set2 3169 A LO V3 S LO V2 | atCaCAAgATGgAAtTTat | 6238 | ATaAATtCCaTCtTGTGat | 6406 | 3151 |
| Set2 3477 A LO V3 S LO V2 | aaTaGAAaATGgTCcAAtt | 6239 | AAtGGaCCaTTtTCTAtt | 6407 | 3459 |
| Set2 865 A LO V3 S LO V2 | gaTgGTGtCTGcTAtTGta | 6240 | TAcAATaGCaGAcACCAtc | 6408 | 847 |
| Set2 1249 A LO V3 S LO V2 | ccAaGCTtTAGtAAaTAta | 6241 | TAtATTtACtAAaGCTTgg | 6409 | 1231 |
| Set2 1250 A LO V3 S LO V2 | caAgCTTtAGTaAaTATaa | 6242 | TTaTATtTAcTAaAGCTtg | 6410 | 1232 |
| Set2 2202 A LO V3 S LO V2 | ctCtGACAGAGTTAcTTca | 6243 | TGaAGTaACtCTgTCAGag | 6411 | 2184 |
| Set2 1545 A LO V3 S LO V2 | caGcTGGaATTcTTtCTaa | 6244 | TTaGAAaGAaTTcCAGCtg | 6412 | 1527 |
| Set2 1755 A LO V3 S LO V2 | gaCtACCaGTTgTGgTTaa | 6245 | TTaACCaCAaCTgGTAGtc | 6413 | 1737 |
| Set2 254 A LO V4 S LO V1 | ccAtACAaCTGtTTtGAaa | 6246 | tTtCAAaACaGTtGTATgg | 6414 | 236 |
| Set2 703 A LO V4 S LO V1 | gaTtAACtATCaAGaTGat | 6247 | aTcATCtTGaTAgTTAAtc | 6415 | 685 |
| Set2 709 A LO V4 S LO V1 | ctAtCAAgATGaTGcAGaa | 6248 | tTcTGCaTCaTCtTGATag | 6416 | 691 |
| Set2 895 A LO V4 S LO V1 | gaAtACAaATGaTGtAGaa | 6249 | tTcTACaTCaTTtGTATtc | 6417 | 877 |
| Set2 1816 A LO V4 S LO V1 | tgTtGGAtTGaTtCgAAat | 6250 | aTtTCGaATCaAtCCAAca | 6418 | 1798 |
| Set2 1974 A LO V4 S LO V1 | ggGtCCGcATGgAAgAAat | 6251 | aTtTCTtCCaTGcGGACcc | 6419 | 1956 |
| Set2 2425 A LO V4 S LO V1 | tcCtAGCtATCgTTcTTtt | 6252 | aAaAGAaCGaTAgCTAGga | 6420 | 2407 |
| Set2 3146 A LO V4 S LO V1 | aaGtGAAgAATgCAcAAga | 6253 | tCtTGTgCAtTCtTCACtt | 6421 | 3128 |
| Set2 889 A LO V4 S LO V1 | caTgCAGaATAcAAaTGat | 6254 | aTcATTtGTaTTcTGCAtg | 6422 | 871 |
| Set2 1814 A LO V4 S LO V1 | acTgTTGgATTgATtCGaa | 6255 | tTcGAAtCAaTCcAACAgt | 6423 | 1796 |

TABLE 3-continued

Beta-Catenin RNAi agents: Example Modified Sequences

| | | | | | |
|---|---|---|---|---|---|
| Set2 1245 A LO V4 S LO V1 | gaCcCCAaGCTtTAgTAaa | 6256 | tTtACTaAAgCTtGGGGtc | 6424 | 1227 |
| Set2 3196 A LO V4 S LO V1 | agCcTTGcTTGtTAaATtt | 6257 | aAaTTTaACaAGcAAGGct | 6425 | 3178 |
| Set2 1450 A LO V4 S LO V1 | ttCaGATgCTGcAAcTAaa | 6258 | tTtAGTtGCaGCaTCTGaa | 6426 | 1432 |
| Set2 3169 A LO V4 S LO V1 | atCaCAAgATGgAAtTTat | 6259 | aTaAATtCCaTCtTGTGat | 6427 | 3151 |
| Set2 3477 A LO V4 S LO V1 | aaTaGAAaATGgTCcAAtt | 6260 | aAtGGaCCaTTtTCTAtt | 6428 | 3459 |
| Set2 865 A LO V4 S LO V1 | gaTgGTGtCTGcTAtTGta | 6261 | tAcAATaGCaGAcACCAtc | 6429 | 847 |
| Set2 1249 A LO V4 S LO V1 | ccAaGCTtTAGtAAaTAta | 6262 | tAtATTtACtAAaGCTTgg | 6430 | 1231 |
| Set2 1250 A LO V4 S LO V1 | caAgCTTtAGTaAAtATaa | 6263 | tTaTATtTAcTAaAGCTtg | 6431 | 1232 |
| Set2 2202 A LO V4 S LO V1 | ctCtGACaGAGtTAcTTca | 6264 | tGaAGTaACtCTgTCAGag | 6432 | 2184 |
| Set2 1545 A LO V4 S LO V1 | caGcTGGaATTcTTtCTaa | 6265 | tTaGAAaGAaTTcCAGCtg | 6433 | 1527 |
| Set2 1755 A LO V4 S LO V1 | gaCtACCaGTTgTGgTTaa | 6266 | tTaACCaCAaCTgGTAGtc | 6434 | 1737 |
| Set2 254 A LO V5 S LO V1 | ccAtACAaCTGtTTtGAaa | 6267 | tTtCAAaACaGTtGTATgg | 6435 | 236 |
| Set2 703 A LO V5 S LO V1 | gaTtAACtATCaAGaTGat | 6268 | aTcATCtTGaTAgTTAAtc | 6436 | 685 |
| Set2 709 A LO V5 S LO V1 | ctAtCAAgATGaTGcAGaa | 6269 | tTcTGCaTCaTCtTGATag | 6437 | 691 |
| Set2 895 A LO V5 S LO V1 | gaAtACAaATGaTGtAGaa | 6270 | tTcTACaTCaTTtGTATtc | 6438 | 877 |
| Set2 1816 A LO V5 S LO V1 | tgTtGGAtTGAtTCgAAat | 6271 | aTtTCGaATcAAtCCAAca | 6439 | 1798 |
| Set2 1974 A LO V5 S LO V1 | ggGtCCGcATGgAAgAAat | 6272 | aTtTCTtCCaTGcGGACcc | 6440 | 1956 |
| Set2 2425 A LO V5 S LO V1 | tcCtAGCtATCgTTcTTtt | 6273 | aAaAGAaCGaTAgCTAGga | 6441 | 2407 |
| Set2 3146 A LO V5 S LO V1 | aaGtGAAgAATgCAcAAga | 6274 | tCtTGTgCAtTCtTCACtt | 6442 | 3128 |
| Set2 889 A LO V5 S LO V1 | caTgCAGaAATAcAAaTGat | 6275 | aTcATTtGTaTTcTGCAtg | 6443 | 871 |
| Set2 1814 A LO V5 S LO V1 | acTgTTGgATTgATtCGaa | 6276 | tTcGAAtCAaTCcAACAgt | 6444 | 1796 |

TABLE 3-continued

Beta-Catenin RNAi agents: Example Modified Sequences

| Set2 1245 A LO V5 S LO V1 | gaCcCCAaGCTtTAgTAaa | 6277 | tTtACTaAAgCTtGGGGtc | 6445 | 1227 |
|---|---|---|---|---|---|
| Set2 3196 A LO V5 S LO V1 | agCcTTGcTTGtTAaATtt | 6278 | aAaTTTaACaAGcAAGGct | 6446 | 3178 |
| Set2 1450 A LO V5 S LO V1 | ttCaGATgCTGcAAcTAaa | 6279 | tTtAGTtGCaGCaTCTGaa | 6447 | 1432 |
| Set2 3169 A LO V5 S LO V1 | atCaCAAgATGgAAtTTat | 6280 | aTaAATtCCaTCtTGTGat | 6448 | 3151 |
| Set2 3477 A LO V5 S LO V1 | aaTaGAAaATGgTCcAAtt | 6281 | aAtTGGaCCaTTtTCTAtt | 6449 | 3459 |
| Set2 865 A LO V5 S LO V1 | gaTgGTGtCTGcTAtTGta | 6282 | tAcAATaGCaGAcACCAtc | 6450 | 847 |
| Set2 1249 A LO V5 S LO V1 | ccAaGCTtTAGtAAaTAta | 6283 | tAtATTtACtAAaGCTTgg | 6451 | 1231 |
| Set2 1250 A LO V5 S LO V1 | caAgCTTtAGTaAAtATaa | 6284 | tTaTATtTAcTAaAGCTtg | 6452 | 1232 |
| Set2 2202 A LO V5 S LO V1 | ctCtGACaGAGtTAcTTca | 6285 | tGaAGTaACtCTgTCAGag | 6453 | 2184 |
| Set2 1545 A LO V5 S LO V1 | caGcTGGaATTcTTtCTaa | 6286 | tTaGAAaGAaTTcCAGCtg | 6454 | 1527 |
| Set2 1755 A LO V5 S LO V1 | gaCtACCaGTTgTGgTTaa | 6287 | tTaACCaCAaCTgGTAGtc | 6455 | 1737 |
| Set2 254 A 48 S26 | ccAtAcAAActGttttGAAA | 6288 | tTTcAAAAcAGTTGtATGG | 6456 | 236 |
| Set2 703 A 48 S26 | GAttAAcTAtcAAGAtGAt | 6289 | aTcATCTTGAtAGTtAATC | 6457 | 685 |
| Set2 709 A 48 S26 | ctAtcAAGAtGAtGcAGAA | 6290 | tTCTGcATcATCTTGAtAG | 6458 | 691 |
| Set2 895 A 48 S26 | GAAtAcAAAtGAtGtAGAA | 6291 | tTCtAcATcATTTGtATTC | 6459 | 877 |
| Set2 1816 A 48 S26 | tGttGGAttGAttcGAAAt | 6292 | aTTTCGAATcAATCcAAcA | 6460 | 1798 |
| Set2 1974 A 48 S26 | GGGtccGcAtGGAAGAAAt | 6293 | aTTTCTTCcATGCGGACCC | 6461 | 1956 |
| Set2 2425 A 48 S26 | tcctAGctAtcGttctttt | 6294 | aAAAGAACGAtAGCtAGGA | 6462 | 2407 |
| Set2 3146 A 48 S26 | AAGtGAAGAAtGcAcAAGA | 6295 | tCTTGTGcATTCTTcACTT | 6463 | 3128 |
| Set2 889 A 48 S26 | cAtGcAGAAtAcAAAtGAt | 6296 | aTcATTTGtATTCTGcATG | 6464 | 871 |
| Set2 1814 A 48 S26 | ActGttGGAttGAttcGAA | 6297 | tTCGAATcAATCcAAcAGT | 6465 | 1796 |
| Set2 1245 A 48 S26 | GAccccAAGctttAGtAAA | 6298 | tTtACtAAAGCTTGGGGTC | 6466 | 1227 |
| Set2 3196 A 48 S26 | AGccttGcttGttAAAttt | 6299 | aAATTtAAcAAGcAAGGCT | 6467 | 3178 |
| Set2 1450 A 48 S26 | ttcAGAtGctGcAActAAA | 6300 | tTtAGTTGcAGcATCTGAA | 6468 | 1432 |

TABLE 3-continued

Beta-Catenin RNAi agents: Example Modified Sequences

| Set2 3169 A 48 S26 | AtcAcAAGAtGGAAtttAt | 6301 | atAAATTCcATCTTGTGAT | 6469 | 3151 |
|---|---|---|---|---|---|
| Set2 3477 A 48 S26 | AAtAGAAAAtGGtccAAtt | 6302 | aATTGGACcATTTTCtATT | 6470 | 3459 |
| Set2 865 A 48 S26 | GAtGGtGtctGctAttGtA | 6303 | tAcAAtAGcAGAcACcATC | 6471 | 847 |
| Set2 1249 A 48 S26 | ccAAGctttAGtAAAtAtA | 6304 | tAtATTtACtAAAGCTTGG | 6472 | 1231 |
| Set2 1250 A 48 S26 | cAAGctttAGtAAAtAtAA | 6305 | ttAtATTtACtAAAGCTTG | 6473 | 1232 |
| Set2 2202 A 48 S26 | ctctGAcAGAGttActtcA | 6306 | tGAAGtAAcTcTGTcAGAG | 6474 | 2184 |
| Set2 1545 A 48 S26 | cAGctGGAAttctttctAA | 6307 | ttAGAAAGAATTCcAGCTG | 6475 | 1527 |
| Set2 1755 A 48 S26 | GActAccAGttGtGGttAA | 6308 | ttAACcAcAACTGGtAGTC | 6476 | 1737 |

| Nickname | First Strand Sequence | SEQ ID NO: | Second Strand Sequence | SEQ ID NO: |
|---|---|---|---|---|
| hs_CTNNB1_1816_AD26740_A22S26 | uGuuGGAuuGAuucGAAAuuu | 6477 | AUUUCGAAUcAAUCcAAcAuu | 6486 |
| hs_CTNNB1_3477_AD-26918-A22S26 | AAuAGAAAAuGGuccAAuuuu | 6478 | AAUUGGACcAUUUUCuAUUuu | 6487 |
| hs_CTNNB1_1814_AD18983_A22S26 | AcuGuuGGAuuGAuucGAAuu | 6479 | UUCGAAUcAAUCcAAcAGUuu | 6488 |
| hs_CTNNB1_709_AD26109_A22S26 | cuAucAAGAuGAuGcAGAAuu | 6480 | UUCUGcAUcAUCUUGAuAGuu | 6489 |
| hs_CTNNB1_254_AD-26034-A22S26 | ccAuAcAAcuGuuuuGAAAuu | 6481 | UUUcAAAAcAGUUGuAUGGuu | 6490 |
| hs_CTNNB1_3169_AD-25944-A22S26 | AucAcAAGAuGGAAuuuAuuu | 6482 | AuAAAUUCcAUCUUGUGAUuu | 6491 |
| hs_CTNNB1_703_AD-26108-A22S26 | AUcAUCUUGAuAGUuAAUCuu | 6483 | uccuAGcuAucGuucuuuuuu | 6492 |
| hs_CTNNB1_2425_AD-26800-A22S26 | uccuAGcuAucGuucuuuuuu | 6484 | AAAAGAACGAuAGCuAGGAuu | 6493 |
| hs_CTNNB1_1974_AD-26752-A22S26 | GGGuccGcAuGGAAGAAAuuu | 6485 | AUUUCUUCcAUGCGGACCCuu | 6494 |

"Position" indicates the position of the RNAi agent in the human Beta-Catenin sequence NM_001098210.1.

The sequences in Table 3 are represented by the abbreviations in Table 3A:

TABLE 3A

| ABBREVIATIONS | |
|---|---|
| Abbreviation[a] | Nucleotide(s) |
| A | adenosine-5'-phosphate |
| C | cytidine-5'-phosphate |
| G | guanosine-5'-phosphate |
| dT | 2'-deoxy-thymidine-5'-phosphate |
| U | uridine-5'-phosphate |
| c | 2'-O-methylcytidine-5'-phosphate |
| u | 2'-O-methyluridine-5'-phosphate |
| sdT | 2'-deoxy Thymidine 5'-phosphorothioate |

Modified and unmodified variants of the RNAi agents of Tables 1, 2 and 3 are easily conceived by one of skill in the art. Unmodified variants include those which do not comprise a modification of the base (such as provided in Table 3). In several cases, a pyrimidine in the sense strand is modified; and/or a pyrimidine preceding a "A" base in the anti-sense strand is modified. Modifications involving other positions (or the absence of a modification at a particular base) are easily conceived.

In general, the sense strand is heavily modified, and the anti-sense strand lightly modified. Some modifications are placed at sites predicted to be sensitive to endonucleases. Some modifications are designed to eliminate an immune response to the RNAi agent while preserving activity. Some modifications serve more than one purpose.

RNAi agents are also on occasion referenced by a "ND" prefix rather than "AD"; thus RNAi agents designated AD-18892 and ND-18892, for example, are identical and comprise the same sequence.

Of the RNAi agents listed herein, many were synthesized, as described in Example 2, and tested in vitro, as described in Example 3.

Example 1A

Overlapping siRNAs

Some of the siRNAs listed above overlap each other in sequence. The following table presents a compilation of groups of RNAi agents, wherein each member of a group overlaps with each other member of the same group by at least 12 nt. A 12-nt portion of the overlap of the sense strands and a 12-nt portion of the overlap of the anti-sense strand are presented. Thus, for example, AD-26022 and AD-26204 share the common technical feature of the sequence of CCUGUUCCCUG (SEQ ID NO: 1319) in the sense strand, and the sequence of CAGGGGAACAGG (SEQ ID NO: 2714) in the anti-sense strand. Note of course that only a 12-nt portion of the overlap is shown; many groups of RNAi agents will overlap by more than 12 nt. The position within the gene is also indicated.

The disclosure also encompasses subgroups of the disclosed groups of overlapping RNAi agents. For example, the disclosure contemplates the group of AD-26027, AD-26024, AD-26028, AD-26026, AD-26025, which all share the sequences of SEQ ID NOs: 1334 and 2729. However, the disclosure also contemplates all subgroups or partial groups within this group, e.g., AD-26027 and AD-26024; AD-26027, AD-26024, AD-26028, and AD-26026; AD-26028, AD-26026, and AD-26025; AD-26027 and AD-26028; AD-26028 and AD-26025; etc. The disclosure thus encompasses any subgroup within a disclosed group of overlapping RNAi agents. The sequences of members of these subgroups can be combined with any other element disclosed herein (e.g., modification, sets of modification, 5' and/or 3' end cap(s), blunt end(s), overhang(s), ligand(s), additional treatment(s) or method(s), pharmaceutical carrier(s), additional RNAi agent(s), etc.), provided that such combinations are not mutually exclusive (e.g., a RNAi agent comprising two strands cannot by definition have both two blunt ends and two overhangs).

TABLE 4

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 206 | CCUGUUCCCUG | 1319 | CAGGGGAACAGG | 2714 | AD-26022, AD-26204 |
| 207 | CUGUUCCCUGA | 1320 | UCAGGGGAACAG | 2715 | AD-26022, AD-26204 |
| 208 | UGUUCCCUGAG | 1321 | CUCAGGGGAACA | 2716 | AD-26022, AD-26023 |
| 209 | GUUCCCUGAGG | 1322 | CCUCAGGGGAAC | 2717 | AD-26022, AD-26023, AD-26204 |
| 210 | UUCCCUGAGGG | 1323 | CCCUCAGGGGAA | 2718 | AD-26022, AD-26023, AD-26204 |
| 211 | UCCCUGAGGGU | 1324 | ACCCUCAGGGGA | 2719 | AD-26022, AD-26023, AD-26204 |
| 212 | CCCUGAGGGUA | 1325 | UACCCUCAGGGG | 2720 | AD-26022, AD-26023, AD-26204 |
| 213 | CCCUGAGGGUAU | 1326 | AUACCCUCAGGG | 2721 | AD-26022, AD-26023 |
| 214 | CCUGAGGGUAUU | 1327 | AAUACCCUCAGG | 2722 | AD-26024, AD-26023 |
| 215 | CUGAGGGUAUUU | 1328 | AAAUACCCUCAG | 2723 | AD-26024, AD-26025 |
| 216 | UGAGGGUAUUUG | 1329 | CAAAUACCCUCA | 2724 | AD-26024, AD-26026 |
| 217 | GAGGGUAUUUGA | 1330 | UCAAAUACCCUC | 2725 | AD-26024, AD-26025 |
| 218 | AGGGUAUUUGAA | 1331 | UUCAAAUACCCU | 2726 | AD-26024, AD-26026, AD-26025 |
| 219 | GGGUAUUUGAAG | 1332 | CUUCAAAUACCC | 2727 | AD-26024, AD-26026, AD-26025 |
| 220 | GGUAUUUGAAGU | 1333 | ACUUCAAAUACC | 2728 | AD-26027, AD-26024, AD-26026, AD-26025 |
| 221 | GUAUUUGAAGUA | 1334 | UACUUCAAAUAC | 2729 | AD-26027, AD-26024, AD-26028, AD-26026, AD-26025 |
| 222 | UAUUUGAAGUAU | 1335 | AUACUUCAAAUA | 2730 | AD-26027, AD-26028, AD-26026, AD-26025 |
| 223 | AUUUGAAGUAUA | 1336 | UAUACUUCAAAU | 2731 | AD-26027, AD-26028 |
| 224 | UUUGAAGUAUAC | 1337 | GUAUACUUCAAA | 2732 | AD-26027, AD-26029 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 225 | UUGAAGUAUACC | 1338 | GGUAUACUUCAA | 2733 | AD-26029, AD-26028 |
| 226 | UGAAGUAUACCA | 1339 | UGGUAUACUUCA | 2734 | AD-26027, AD-26029, AD-26028 |
| 227 | GAAGUAUACCAU | 1340 | AUGGUAUACUUC | 2735 | AD-26027, AD-26029, AD-26028 |
| 228 | AAGUAUACCAUA | 1341 | UAUGGUAUACUU | 2736 | AD-26029, AD-26028 |
| 229 | AGUAUACCAUAC | 1342 | GUAUGGUAUACU | 2737 | AD-26029, AD-26030 |
| 230 | GUAUACCAUACA | 1343 | UGUAUGGUAUAC | 2738 | AD-26031, AD-26029, AD-26030 |
| 231 | UAUACCAUACAA | 1344 | UUGUAUGGUAUA | 2739 | AD-26032, AD-26031, AD-26029, AD-26030 |
| 232 | AUACCAUACAAC | 1345 | GUUGUAUGGUAU | 2740 | AD-26032, AD-26031 |
| 233 | UACCAUACAACU | 1346 | AGUUGUAUGGUA | 2741 | AD-26032, AD-26031, AD-26030 |
| 234 | ACCAUACAACUG | 1347 | CAGUUGUAUGGU | 2742 | AD-26032, AD-26031, AD-26033, AD-26030 |
| 235 | CCAUACAACUGU | 1348 | ACAGUUGUAUGG | 2743 | AD-26032, AD-26034, AD-26031, AD-26033, AD-26030 |
| 236 | CAUACAACUGUU | 1349 | AACAGUUGUAUG | 2744 | AD-26032, AD-26034, AD-26031, AD-26033, AD-26030 |
| 237 | AUACAACUGUUU | 1350 | AAACAGUUGUAU | 2745 | AD-26032, AD-26034, AD-26031, AD-26033 |
| 238 | UACAACUGUUUU | 1351 | AAAACAGUUGUA | 2746 | AD-26032, AD-26034, AD-26033 |
| 239 | ACAACUGUUUUG | 1352 | CAAAACAGUUGU | 2747 | AD-26034, AD-26033 |
| 240 | CAACUGUUUUGA | 1353 | UCAAAACAGUUG | 2748 | AD-26034, AD-26033 |
| 241 | AACUGUUUUGAA | 1354 | UUCAAAACAGUU | 2749 | AD-26034, AD-26033 |
| 250 | GAAAUCCAGCG | 1355 | CGCUGGAUUUUC | 2750 | AD-19763, AD-26035 |
| 251 | AAAUCCAGCGU | 1356 | ACGCUGGAUUUU | 2751 | AD-26036, AD-19763, AD-26035 |
| 252 | AAAUCCAGCGUG | 1357 | CACGCUGGAUUU | 2752 | AD-26036, AD-19763, AD-26035 |
| 253 | AAUCCAGCGUGG | 1358 | CCACGCUGGAUU | 2753 | AD-26036, AD-26035 |
| 254 | AUCCAGCGUGGA | 1359 | UCCACGCUGGAU | 2754 | AD-26036, AD-26035 |
| 255 | UCCAGCGUGGAC | 1360 | GUCCACGCUGGA | 2755 | AD-26036, AD-26035 |
| 256 | CCAGCGUGGACA | 1361 | UGUCCACGCUGG | 2756 | AD-26036, AD-26035, AD-26037 |
| 257 | CAGCGUGGACAA | 1362 | UUGUCCACGCUG | 2757 | AD-26036, AD-26035, AD-26037 |
| 258 | AGCGUGGACAAU | 1363 | AUUGUCCACGCU | 2758 | AD-26036, AD-26037 |
| 261 | GUGGACAAUGGC | 1364 | GCCAUUGUCCAC | 2759 | AD-26038, AD-26037 |
| 262 | UGGACAAUGGCU | 1365 | AGCCAUUGUCCA | 2760 | AD-26038, AD-26037 |
| 263 | GGACAAUGGCUA | 1366 | UAGCCAUUGUCC | 2761 | AD-26038, AD-26037 |

TABLE 4-continued

Groups of overlapping RNAi agents to Beta-Catenin

| Position | Sense overlap | SEQ ID NO: Anti-sense overlap | | SEQ ID NO: | Overlapping groups of RNAi agents |
|---|---|---|---|---|---|
| 264 | GACAAUGGCUAC | 1367 | GUAGCCAUUGUC | 2762 | AD-18896, AD-26038 |
| 265 | ACAAUGGCUACU | 1368 | AGUAGCCAUUGU | 2763 | AD-18896, AD-26038, AD-18953 |
| 266 | CAAUGGCUACUC | 1369 | GAGUAGCCAUUG | 2764 | AD-18896, AD-26038, AD-18953 |
| 267 | AAUGGCUACUCA | 1370 | UGAGUAGCCAUU | 2765 | AD-18896, AD-26038, AD-18953 |
| 268 | AUGGCUACUCAA | 1371 | UUGAGUAGCCAU | 2766 | AD-18896, AD-26038, AD-18953, AD-26040 |
| 269 | UGGCUACUCAAG | 1372 | CUUGAGUAGCCA | 2767 | AD-18896, AD-26041, AD-18953, AD-26040 |
| 270 | GGCUACUCAAGC | 1373 | GCUUGAGUAGCC | 2768 | AD-18896, AD-26041, AD-26039, AD-18953, AD-26040 |
| 271 | GCUACUCAAGCU | 1374 | AGCUUGAGUAGC | 2769 | AD-18896, AD-26041, AD-18953, AD-26040 |
| 272 | CUACUCAAGCUG | 1375 | CAGCUUGAGUAG | 2770 | AD-26041, AD-26042, AD-18953, AD-26040 |
| 273 | UACUCAAGCUGA | 1376 | UCAGCUUGAGUA | 2771 | AD-26041, AD-26042, AD-26040 |
| 274 | ACUCAAGCUGAU | 1377 | AUCAGCUUGAGU | 2772 | AD-26041, AD-26042, AD-26039, AD-26040 |
| 275 | CUCAAGCUGAUU | 1378 | AAUCAGCUUGAG | 2773 | AD-26041, AD-26042, AD-26040 |
| 276 | UCAAGCUGAUUU | 1379 | AAAUCAGCUUGA | 2774 | AD-26041, AD-26042 |
| 290 | UGGAGUUGGACA | 1380 | UGUCCAACUCCA | 2775 | AD-26043, AD-26044 |
| 291 | GGAGUUGGACAU | 1381 | AUGUCCAACUCC | 2776 | AD-26043, AD-26044 |
| 294 | GUUGGACAUGGC | 1382 | GCCAUGUCCAAC | 2777 | AD-26045, AD-26044 |
| 295 | UUGGACAUGGCC | 1383 | GGCCAUGUCCAA | 2778 | AD-26045, AD-26044 |
| 296 | UGGACAUGGCCA | 1384 | UGGCCAUGUCCA | 2779 | AD-26045, AD-26044 |
| 297 | GGACAUGGCCAU | 1385 | AUGGCCAUGUCC | 2780 | AD-26045, AD-26044 |
| 306 | CAUGGAACCAGA | 1386 | UCUGGUUCCAUG | 2781 | AD-26047, AD-26046 |
| 307 | AUGGAACCAGAC | 1387 | GUCUGGUUCCAU | 2782 | AD-26047, AD-26046 |
| 308 | UGGAACCAGACA | 1388 | UGUCUGGUUCCA | 2783 | AD-26047, AD-26046 |
| 309 | GGAACCAGACAG | 1389 | CUGUCUGGUUCC | 2784 | AD-26047, AD-26046 |
| 310 | GAACCAGACAGA | 1390 | UCUGUCUGGUUC | 2785 | AD-26047, AD-26046 |
| 311 | AACCAGACAGAA | 1391 | UUCUGUCUGGUU | 2786 | AD-26047, AD-26046 |
| 316 | GACAGAAAAGCG | 1392 | CGCUUUUCUGUC | 2787 | AD-26050, AD-26049 |
| 317 | ACAGAAAAGCGG | 1393 | CCGCUUUUCUGU | 2788 | AD-26050, AD-26049 |
| 318 | CAGAAAAGCGGC | 1394 | GCCGCUUUUCUG | 2789 | AD-26050, AD-26049 |
| 319 | AGAAAAGCGGCU | 1395 | AGCCGCUUUUCU | 2790 | AD-26050, AD-26049 |
| 320 | GAAAAGCGGCUG | 1396 | CAGCCGCUUUUC | 2791 | AD-26050, AD-26049 |
| 321 | AAAAGCGGCUGU | 1397 | ACAGCCGCUUUU | 2792 | AD-26050, AD-26049 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 322 | AAAGCGGCUGUU | 1398 | AACAGCCGCUUU | 2793 | AD-26050, AD-26049 |
| 323 | AAGCGGCUGUUA | 1399 | UAACAGCCGCUU | 2794 | AD-26050, AD-19743 |
| 330 | UGUUAGUCACUG | 1400 | CAGUGACUAACA | 2795 | AD-26051, AD-19743 |
| 337 | CACUGGCAGCAA | 1401 | UUGCUGCCAGUG | 2796 | AD-26051, AD-26052 |
| 338 | ACUGGCAGCAAC | 1402 | GUUGCUGCCAGU | 2797 | AD-26053, AD-26052 |
| 339 | CUGGCAGCAACA | 1403 | UGUUGCUGCCAG | 2798 | AD-26053, AD-26052 |
| 340 | UGGCAGCAACAG | 1404 | CUGUUGCUGCCA | 2799 | AD-26053, AD-26052 |
| 341 | GGCAGCAACAGU | 1405 | ACUGUUGCUGCC | 2800 | AD-26053, AD-26052 |
| 342 | GCAGCAACAGUC | 1406 | GACUGUUGCUGC | 2801 | AD-26053, AD-26052 |
| 343 | CAGCAACAGUCU | 1407 | AGACUGUUGCUG | 2802 | AD-26053, AD-26052 |
| 344 | AGCAACAGUCUU | 1408 | AAGACUGUUGCU | 2803 | AD-26053, AD-26052 |
| 353 | CUUACCUGGACU | 1409 | AGUCCAGGUAAG | 2804 | AD-26054, AD-26055 |
| 354 | UUACCUGGACUC | 1410 | GAGUCCAGGUAA | 2805 | AD-26054, AD-26055 |
| 355 | UACCUGGACUCU | 1411 | AGAGUCCAGGUA | 2806 | AD-26054, AD-26055 |
| 356 | ACCUGGACUCUG | 1412 | CAGAGUCCAGGU | 2807 | AD-26054, AD-26055 |
| 357 | CCUGGACUCUGG | 1413 | CCAGAGUCCAGG | 2808 | AD-26056, AD-26055 |
| 358 | CUGGACUCUGGA | 1414 | UCCAGAGUCCAG | 2809 | AD-26054, AD-26056, AD-26055 |
| 359 | UGGACUCUGGAA | 1415 | UUCCAGAGUCCA | 2810 | AD-26054, AD-26056, AD-26055 |
| 360 | GGACUCUGGAAU | 1416 | AUUCCAGAGUCC | 2811 | AD-26056, AD-26055 |
| 366 | UGGAAUCCAUUC | 1417 | GAAUGGAUUCCA | 2812 | AD-19072, AD-18925 |
| 367 | GGAAUCCAUUCU | 1418 | AGAAUGGAUUCC | 2813 | AD-19072, AD-18925 |
| 368 | GAAUCCAUUCUG | 1419 | CAGAAUGGAUUC | 2814 | AD-19072, AD-18925 |
| 369 | AAUCCAUUCUGG | 1420 | CCAGAAUGGAUU | 2815 | AD-19072, AD-18925 |
| 370 | AUCCAUUCUGGU | 1421 | ACCAGAAUGGAU | 2816 | AD-19072, AD-18925 |
| 371 | UCCAUUCUGGUG | 1422 | CACCAGAAUGGA | 2817 | AD-19072, AD-18925 |
| 372 | CCAUUCUGGUGC | 1423 | GCACCAGAAUGG | 2818 | AD-19072, AD-18925 |
| 401 | CUCUGAGUGGUA | 1424 | UACCACUCAGAG | 2819 | AD-26060, AD-26059 |
| 402 | UCUGAGUGGUAA | 1425 | UUACCACUCAGA | 2820 | AD-26060, AD-26059 |
| 403 | CUGAGUGGUAAA | 1426 | UUUACCACUCAG | 2821 | AD-26060, AD-26059 |
| 417 | CAAUCCUGAGGA | 1427 | UCCUCAGGAUUG | 2822 | AD-26062, AD-26061 |
| 418 | AAUCCUGAGGAA | 1428 | UUCCUCAGGAUU | 2823 | AD-26062, AD-26061 |
| 423 | UGAGGAAGAGGA | 1429 | UCCUCUUCCUCA | 2824 | AD-26062, AD-26063 |
| 424 | GAGGAAGAGGAU | 1430 | AUCCUCUUCCUC | 2825 | AD-26062, AD-26063 |
| 441 | UACCUCCCAAGU | 1431 | ACUUGGGAGGUA | 2826 | AD-26065, AD-26064 |
| 442 | ACCUCCCAAGUC | 1432 | GACUUGGGAGGU | 2827 | AD-26065, AD-26064 |
| 443 | CCUCCCAAGUCC | 1433 | GGACUUGGGAGG | 2828 | AD-26065, AD-26064 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 444 | CUCCCAAGUCCU | 1434 | AGGACUUGGGAG | 2829 | AD-26065, AD-26064 |
| 445 | UCCCAAGUCCUG | 1435 | CAGGACUUGGGA | 2830 | AD-26065, AD-26064 |
| 446 | CCCAAGUCCUGU | 1436 | ACAGGACUUGGG | 2831 | AD-26065, AD-26064 |
| 447 | CCAAGUCCUGUA | 1437 | UACAGGACUUGG | 2832 | AD-26065, AD-26064 |
| 457 | UAUGAGUGGGAA | 1438 | UUCCCACUCAUA | 2833 | AD-26066, AD-26067 |
| 459 | UGAGUGGGAACA | 1439 | UGUUCCCACUCA | 2834 | AD-26070, AD-26067 |
| 460 | GAGUGGGAACAG | 1440 | CUGUUCCCACUC | 2835 | AD-26071, AD-26070, AD-26067 |
| 461 | AGUGGGAACAGG | 1441 | CCUGUUCCCACU | 2836 | AD-26071, AD-26070, AD-26067 |
| 462 | GUGGGAACAGGG | 1442 | CCCUGUUCCCAC | 2837 | AD-26071, AD-26070, AD-26067 |
| 463 | UGGGAACAGGGA | 1443 | UCCCUGUUCCCA | 2838 | AD-26071, AD-26070, AD-26067 |
| 464 | GGGAACAGGGAU | 1444 | AUCCCUGUUCCC | 2839 | AD-26071, AD-26070, AD-26067 |
| 465 | GGAACAGGGAUU | 1445 | AAUCCCUGUUCC | 2840 | AD-26071, AD-26070 |
| 466 | GAACAGGGAUUU | 1446 | AAAUCCCUGUUC | 2841 | AD-26071, AD-26070 |
| 477 | UUCUCAGUCCUU | 1447 | AAGGACUGAGAA | 2842 | AD-26073, AD-26072 |
| 480 | UCAGUCCUUCAC | 1448 | GUGAAGGACUGA | 2843 | AD-26074, AD-26073 |
| 481 | CAGUCCUUCACU | 1449 | AGUGAAGGACUG | 2844 | AD-26074, AD-26073 |
| 482 | AGUCCUUCACUC | 1450 | GAGUGAAGGACU | 2845 | AD-26074, AD-26073 |
| 483 | GUCCUUCACUCA | 1451 | UGAGUGAAGGAC | 2846 | AD-26074, AD-26073 |
| 484 | UCCUUCACUCAA | 1452 | UUGAGUGAAGGA | 2847 | AD-26074, AD-26073 |
| 486 | CUUCACUCAAGA | 1453 | UCUUGAGUGAAG | 2848 | AD-26074, AD-26075 |
| 487 | UUCACUCAAGAA | 1454 | UUCUUGAGUGAA | 2849 | AD-26074, AD-26075 |
| 492 | UCAAGAACAAGU | 1455 | ACUUGUUCUUGA | 2850 | AD-26076, AD-26075 |
| 493 | CAAGAACAAGUA | 1456 | UACUUGUUCUUG | 2851 | AD-26076, AD-26075 |
| 511 | AUUGAUGGACAG | 1457 | CUGUCCAUCAAU | 2852 | AD-26077, AD-26078 |
| 512 | UUGAUGGACAGU | 1458 | ACUGUCCAUCAA | 2853 | AD-26077, AD-26078 |
| 513 | UGAUGGACAGUA | 1459 | UACUGUCCAUCA | 2854 | AD-26077, AD-26078 |
| 523 | UAUGCAAUGACU | 1460 | AGUCAUUGCAUA | 2855 | AD-19757, AD-19756 |
| 524 | AUGCAAUGACUC | 1461 | GAGUCAUUGCAU | 2856 | AD-19757, AD-19756 |
| 525 | UGCAAUGACUCG | 1462 | CGAGUCAUUGCA | 2857 | AD-19757, AD-19756 |
| 526 | GCAAUGACUCGA | 1463 | UCGAGUCAUUGC | 2858 | AD-19757, AD-19756 |
| 534 | UCGAGCUCAGAG | 1464 | CUCUGAGCUCGA | 2859 | AD-19744, AD-26079 |
| 535 | CGAGCUCAGAGG | 1465 | CCUCUGAGCUCG | 2860 | AD-19744, AD-26079 |
| 536 | GAGCUCAGAGGG | 1466 | CCCUCUGAGCUC | 2861 | AD-19744, AD-26079 |
| 537 | AGCUCAGAGGGU | 1467 | ACCCUCUGAGCU | 2862 | AD-19744, AD-26079 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 538 | GCUCAGAGGGUA | 1468 | UACCCUCUGAGC | 2863 | AD-19744, AD-26079 |
| 541 | CAGAGGGUACGA | 1469 | UCGUACCCUCUG | 2864 | AD-26080, AD-19744 |
| 542 | AGAGGGUACGAG | 1470 | CUCGUACCCUCU | 2865 | AD-26080, AD-26081 |
| 543 | GAGGGUACGAGC | 1471 | GCUCGUACCCUC | 2866 | AD-26080, AD-26081 |
| 544 | AGGGUACGAGCU | 1472 | AGCUCGUACCCU | 2867 | AD-26080, AD-26081 |
| 545 | GGGUACGAGCUG | 1473 | CAGCUCGUACCC | 2868 | AD-26080, AD-26081 |
| 546 | GGUACGAGCUGC | 1474 | GCAGCUCGUACC | 2869 | AD-26080, AD-26082 |
| 547 | GUACGAGCUGCU | 1475 | AGCAGCUCGUAC | 2870 | AD-26080, AD-26081, AD-26082 |
| 548 | UACGAGCUGCUA | 1476 | UAGCAGCUCGUA | 2871 | AD-26080, AD-26081, AD-26082 |
| 549 | ACGAGCUGCUAU | 1477 | AUAGCAGCUCGU | 2872 | AD-26081, AD-26082 |
| 558 | UAUGUUCCCUGA | 1478 | UCAGGGAACAUA | 2873 | AD-26084, AD-26083 |
| 559 | AUGUUCCCUGAG | 1479 | CUCAGGGAACAU | 2874 | AD-26084, AD-26083 |
| 560 | UGUUCCCUGAGA | 1480 | UCUCAGGGAACA | 2875 | AD-26084, AD-26083 |
| 561 | GUUCCCUGAGAC | 1481 | GUCUCAGGGAAC | 2876 | AD-26084, AD-26085, AD-26083 |
| 562 | UUCCCUGAGACA | 1482 | UGUCUCAGGGAA | 2877 | AD-26084, AD-26085, AD-26083 |
| 563 | UCCCUGAGACAU | 1483 | AUGUCUCAGGGA | 2878 | AD-26084, AD-26085, AD-26083 |
| 564 | CCCUGAGACAUU | 1484 | AAUGUCUCAGGG | 2879 | AD-26084, AD-26085, AD-26083 |
| 565 | CCUGAGACAUUA | 1485 | UAAUGUCUCAGG | 2880 | AD-26084, AD-26085 |
| 576 | AGAUGAGGGCAU | 1486 | AUGCCCUCAUCU | 2881 | AD-26086, AD-18911 |
| 577 | GAUGAGGGCAUG | 1487 | CAUGCCCUCAUC | 2882 | AD-26086, AD-18911 |
| 578 | AUGAGGGCAUGC | 1488 | GCAUGCCCUCAU | 2883 | AD-19011, AD-18911 |
| 579 | UGAGGGCAUGCA | 1489 | UGCAUGCCCUCA | 2884 | AD-26086, AD-19011, AD-18911 |
| 580 | GAGGGCAUGCAG | 1490 | CUGCAUGCCCUC | 2885 | AD-18911, AD-26087 |
| 581 | AGGGCAUGCAGA | 1491 | UCUGCAUGCCCU | 2886 | AD-18959, AD-26086, AD-18911, AD-26087 |
| 582 | GGGCAUGCAGAU | 1492 | AUCUGCAUGCCC | 2887 | AD-18911, AD-26087 |
| 583 | GGCAUGCAGAUC | 1493 | GAUCUGCAUGCC | 2888 | AD-26088, AD-18911, AD-26087 |
| 584 | GCAUGCAGAUCC | 1494 | GGAUCUGCAUGC | 2889 | AD-26088, AD-26087 |
| 585 | CAUGCAGAUCCC | 1495 | GGGAUCUGCAUG | 2890 | AD-26088, AD-18959, AD-19011, AD-26087 |
| 586 | AUGCAGAUCCCA | 1496 | UGGGAUCUGCAU | 2891 | AD-26088, AD-26087 |
| 587 | UGCAGAUCCCAU | 1497 | AUGGGAUCUGCA | 2892 | AD-26088, AD-18959 |
| 588 | GCAGAUCCCAUC | 1498 | GAUGGGAUCUGC | 2893 | AD-26088, AD-18959 |
| 590 | AGAUCCCAUCUA | 1499 | UAGAUGGGAUCU | 2894 | AD-26088, AD-26089 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 594 | CCCAUCUACACA | 1500 | UGUGUAGAUGGG | 2895 | AD-26089, AD-26090 |
| 595 | CCAUCUACACAG | 1501 | CUGUGUAGAUGG | 2896 | AD-26089, AD-26090 |
| 596 | CAUCUACACAGU | 1502 | ACUGUGUAGAUG | 2897 | AD-26089, AD-26090 |
| 597 | AUCUACACAGUU | 1503 | AACUGUGUAGAU | 2898 | AD-26089, AD-26090 |
| 610 | GAUGCUGCUCAU | 1504 | AUGAGCAGCAUC | 2899 | AD-26091, AD-26092 |
| 611 | AUGCUGCUCAUC | 1505 | GAUGAGCAGCAU | 2900 | AD-26092, AD-26093 |
| 612 | UGCUGCUCAUCC | 1506 | GGAUGAGCAGCA | 2901 | AD-26092, AD-26094 |
| 613 | GCUGCUCAUCCC | 1507 | GGGAUGAGCAGC | 2902 | AD-26092, AD-26093 |
| 614 | CUGCUCAUCCCA | 1508 | UGGGAUGAGCAG | 2903 | AD-26092, AD-26093, AD-26094 |
| 615 | UGCUCAUCCCAC | 1509 | GUGGGAUGAGCA | 2904 | AD-26092, AD-26093, AD-26094 |
| 616 | GCUCAUCCCACU | 1510 | AGUGGGAUGAGC | 2905 | AD-26092, AD-26093, AD-26094 |
| 617 | CUCAUCCCACUA | 1511 | UAGUGGGAUGAG | 2906 | AD-26092, AD-26094 |
| 618 | UCAUCCCACUAA | 1512 | UUAGUGGGAUGA | 2907 | AD-19070, AD-18949, AD-26093, AD-26094 |
| 619 | CAUCCCACUAAU | 1513 | AUUAGUGGGAUG | 2908 | AD-18949, AD-19048, AD-18954, AD-26094 |
| 620 | AUCCCACUAAUG | 1514 | CAUUAGUGGGAU | 2909 | AD-19070, AD-18918, AD-19048, AD-18954 |
| 621 | UCCCACUAAUGU | 1515 | ACAUUAGUGGGA | 2910 | AD-19070, AD-18949, AD-18918, AD-19048, AD-18954 |
| 622 | CCCACUAAUGUC | 1516 | GACAUUAGUGGG | 2911 | AD-26095, AD-19070, AD-18918, AD-19048, AD-18954 |
| 623 | CCACUAAUGUCC | 1517 | GGACAUUAGUGG | 2912 | AD-26095, AD-18949, AD-18918, AD-19048, AD-18954 |
| 624 | CACUAAUGUCCA | 1518 | UGGACAUUAGUG | 2913 | AD-26095, AD-18949, AD-18918, AD-19048, AD-18954 |
| 625 | ACUAAUGUCCAG | 1519 | CUGGACAUUAGU | 2914 | AD-26095, AD-18918, AD-19048 |
| 626 | CUAAUGUCCAGC | 1520 | GCUGGACAUUAG | 2915 | AD-26095, AD-18918, AD-19048 |
| 627 | UAAUGUCCAGCG | 1521 | CGCUGGACAUUA | 2916 | AD-26095, AD-18918 |
| 636 | GCGUUUGGCUGA | 1522 | UCAGCCAAACGC | 2917 | AD-26096, AD-19765 |
| 637 | CGUUUGGCUGAA | 1523 | UUCAGCCAAACG | 2918 | AD-26096, AD-19765 |
| 638 | GUUUGGCUGAAC | 1524 | GUUCAGCCAAAC | 2919 | AD-26096, AD-19765 |
| 639 | UUUGGCUGAACC | 1525 | GGUUCAGCCAAA | 2920 | AD-26096, AD-19765 |
| 640 | UUGGCUGAACCA | 1526 | UGGUUCAGCCAA | 2921 | AD-26096, AD-18974, AD-19765 |
| 641 | UGGCUGAACCAU | 1527 | AUGGUUCAGCCA | 2922 | AD-26096, AD-19765, AD-26097 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 642 | GGCUGAACCAUC | 1528 | GAUGGUUCAGCC | 2923 | AD-18974, AD-19000, AD-19765, AD-26097 |
| 643 | GCUGAACCAUCA | 1529 | UGAUGGUUCAGC | 2924 | AD-18974, AD-19765, AD-26097 |
| 644 | CUGAACCAUCAC | 1530 | GUGAUGGUUCAG | 2925 | AD-18974, AD-19000 |
| 645 | UGAACCAUCACA | 1531 | UGUGAUGGUUCA | 2926 | AD-18974, AD-26097 |
| 646 | GAACCAUCACAG | 1532 | CUGUGAUGGUUC | 2927 | AD-18974, AD-19000, AD-26097 |
| 647 | AACCAUCACAGA | 1533 | UCUGUGAUGGUU | 2928 | AD-18974, AD-19000, AD-26098, AD-26097 |
| 648 | ACCAUCACAGAU | 1534 | AUCUGUGAUGGU | 2929 | AD-19000, AD-26098, AD-26099, AD-26097 |
| 649 | CCAUCACAGAUG | 1535 | CAUCUGUGAUGG | 2930 | AD-19000, AD-26098, AD-26099 |
| 650 | CAUCACAGAUGC | 1536 | GCAUCUGUGAUG | 2931 | AD-26098, AD-26099 |
| 651 | AUCACAGAUGCU | 1537 | AGCAUCUGUGAU | 2932 | AD-26100, AD-26098 |
| 652 | UCACAGAUGCUG | 1538 | CAGCAUCUGUGA | 2933 | AD-26100, AD-26099 |
| 653 | CACAGAUGCUGA | 1539 | UCAGCAUCUGUG | 2934 | AD-26100, AD-26098, AD-26099 |
| 654 | ACAGAUGCUGAA | 1540 | UUCAGCAUCUGU | 2935 | AD-26100, AD-26099 |
| 655 | CAGAUGCUGAAA | 1541 | UUUCAGCAUCUG | 2936 | AD-26100, AD-26099 |
| 657 | GAUGCUGAAACA | 1542 | UGUUUCAGCAUC | 2937 | AD-26100, AD-26101 |
| 658 | AUGCUGAAACAU | 1543 | AUGUUUCAGCAU | 2938 | AD-26100, AD-26101 |
| 661 | CUGAAACAUGCA | 1544 | UGCAUGUUUCAG | 2939 | AD-26101, AD-26102 |
| 662 | UGAAACAUGCAG | 1545 | CUGCAUGUUUCA | 2940 | AD-26101, AD-26102 |
| 663 | GAAACAUGCAGU | 1546 | ACUGCAUGUUUC | 2941 | AD-26101, AD-26102 |
| 664 | AAACAUGCAGUU | 1547 | AACUGCAUGUUU | 2942 | AD-26101, AD-26102 |
| 665 | AACAUGCAGUUG | 1548 | CAACUGCAUGUU | 2943 | AD-26103, AD-26102 |
| 666 | ACAUGCAGUUGU | 1549 | ACAACUGCAUGU | 2944 | AD-26103, AD-26102 |
| 667 | CAUGCAGUUGUA | 1550 | UACAACUGCAUG | 2945 | AD-26103, AD-26102 |
| 668 | AUGCAGUUGUAA | 1551 | UUACAACUGCAU | 2946 | AD-26104, AD-26103, AD-26102 |
| 669 | UGCAGUUGUAAA | 1552 | UUUACAACUGCA | 2947 | AD-26105, AD-26103 |
| 670 | GCAGUUGUAAAC | 1553 | GUUUACAACUGC | 2948 | AD-26105, AD-26104, AD-26103 |
| 671 | CAGUUGUAAACU | 1554 | AGUUUACAACUG | 2949 | AD-26105, AD-26104, AD-26103, AD-26106 |
| 672 | AGUUGUAAACUU | 1555 | AAGUUUACAACU | 2950 | AD-26105, AD-26103, AD-26106 |
| 673 | GUUGUAAACUUG | 1556 | CAAGUUUACAAC | 2951 | AD-26105, AD-26104, AD-26106 |
| 674 | UUGUAAACUUGA | 1557 | UCAAGUUUACAA | 2952 | AD-26105, AD-26808, AD-26104, AD-26106 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 675 | UGUAAACUUGAU | 1558 | AUCAAGUUUACA | 2953 | AD-26105, AD-26808, AD-26104, AD-26106, AD-26809 |
| 676 | GUAAACUUGAUU | 1559 | AAUCAAGUUUAC | 2954 | AD-26105, AD-26808, AD-26106, AD-26809 |
| 677 | UAAACUUGAUUA | 1560 | UAAUCAAGUUUA | 2955 | AD-26808, AD-26106, AD-26809 |
| 678 | AAACUUGAUUAA | 1561 | UUAAUCAAGUUU | 2956 | AD-26808, AD-26810, AD-26106, AD-26809 |
| 679 | AACUUGAUUAAC | 1562 | GUUAAUCAAGUU | 2957 | AD-26808, AD-26810, AD-26809 |
| 680 | ACUUGAUUAACU | 1563 | AGUUAAUCAAGU | 2958 | AD-26808, AD-26809 |
| 681 | CUUGAUUAACUA | 1564 | UAGUUAAUCAAG | 2959 | AD-26107, AD-26808, AD-26810, AD-26809 |
| 682 | UUGAUUAACUAU | 1565 | AUAGUUAAUCAA | 2960 | AD-26107, AD-26810, AD-26809 |
| 683 | UGAUUAACUAUC | 1566 | GAUAGUUAAUCA | 2961 | AD-26107, AD-26810 |
| 684 | GAUUAACUAUCA | 1567 | UGAUAGUUAAUC | 2962 | AD-26107, AD-26810, AD-26108 |
| 685 | AUUAACUAUCAA | 1568 | UUGAUAGUUAAU | 2963 | AD-26107, AD-26108 |
| 686 | UUAACUAUCAAG | 1569 | CUUGAUAGUUAA | 2964 | AD-26107, AD-26108 |
| 687 | UAACUAUCAAGA | 1570 | UCUUGAUAGUUA | 2965 | AD-26107, AD-26108 |
| 688 | AACUAUCAAGAU | 1571 | AUCUUGAUAGUU | 2966 | AD-26107, AD-26108 |
| 690 | CUAUCAAGAUGA | 1572 | UCAUCUUGAUAG | 2967 | AD-26109, AD-26108 |
| 691 | UAUCAAGAUGAU | 1573 | AUCAUCUUGAUA | 2968 | AD-26109, AD-26108 |
| 707 | AACUUGCCACAC | 1574 | GUGUGGCAAGUU | 2969 | AD-26110, AD-26111 |
| 708 | ACUUGCCACACG | 1575 | CGUGUGGCAAGU | 2970 | AD-26110, AD-26111 |
| 709 | CUUGCCACACGU | 1576 | ACGUGUGGCAAG | 2971 | AD-26110, AD-26111 |
| 710 | UUGCCACACGUG | 1577 | CACGUGUGGCAA | 2972 | AD-26110, AD-26111 |
| 711 | UGCCACACGUGC | 1578 | GCACGUGUGGCA | 2973 | AD-26110, AD-26111 |
| 712 | GCCACACGUGCA | 1579 | UGCACGUGUGGC | 2974 | AD-26110, AD-26111 |
| 713 | CCACACGUGCAA | 1580 | UUGCACGUGUGG | 2975 | AD-26110, AD-26111 |
| 714 | CACACGUGCAAU | 1581 | AUUGCACGUGUG | 2976 | AD-26112, AD-26111 |
| 721 | GCAAUCCCUGAA | 1582 | UUCAGGGAUUGC | 2977 | AD-26112, AD-26123 |
| 722 | CAAUCCCUGAAC | 1583 | GUUCAGGGAUUG | 2978 | AD-26124, AD-26123 |
| 723 | AAUCCCUGAACU | 1584 | AGUUCAGGGAUU | 2979 | AD-26124, AD-26125 |
| 724 | AUCCCUGAACUG | 1585 | CAGUUCAGGGAU | 2980 | AD-26124, AD-26123 |
| 725 | UCCCUGAACUGA | 1586 | UCAGUUCAGGGA | 2981 | AD-26124, AD-26125 |
| 726 | CCCUGAACUGAC | 1587 | GUCAGUUCAGGG | 2982 | AD-26124, AD-26123 |
| 727 | CCUGAACUGACA | 1588 | UGUCAGUUCAGG | 2983 | AD-26124, AD-26123, AD-26125 |

TABLE 4-continued

Groups of overlapping RNAi agents to Beta-Catenin

| Position | Sense overlap | SEQ ID NO: Anti-sense overlap | SEQ ID NO: Overlapping groups of RNAi agents |
|---|---|---|---|
| 728 | CUGAACUGACAA | 1589 UUGUCAGUUCAG | 2984 AD-26124, AD-26123, AD-26125 |
| 729 | UGAACUGACAAA | 1590 UUUGUCAGUUCA | 2985 AD-26124, AD-26125, AD-26126 |
| 730 | GAACUGACAAAA | 1591 UUUUGUCAGUUC | 2986 AD-26125, AD-26126 |
| 731 | AACUGACAAAAC | 1592 GUUUUGUCAGUU | 2987 AD-26128, AD-26126, AD-26127 |
| 732 | ACUGACAAAACU | 1593 AGUUUUGUCAGU | 2988 AD-26128, AD-26126, AD-26129 |
| 733 | CUGACAAAACUG | 1594 CAGUUUUGUCAG | 2989 AD-26128, AD-26126, AD-26129 |
| 734 | UGACAAAACUGC | 1595 GCAGUUUUGUCA | 2990 AD-26128, AD-26127, AD-26129 |
| 735 | GACAAAACUGCU | 1596 AGCAGUUUUGUC | 2991 AD-26128, AD-26126, AD-26129 |
| 736 | ACAAAACUGCUA | 1597 UAGCAGUUUUGU | 2992 AD-26128, AD-26126, AD-26127, AD-26129 |
| 737 | CAAAACUGCUAA | 1598 UUAGCAGUUUUG | 2993 AD-26128, AD-26127, AD-26129 |
| 738 | AAAACUGCUAAA | 1599 UUUAGCAGUUUU | 2994 AD-26128, AD-26129 |
| 755 | AGGACCAGGUGG | 1600 CCACCUGGUCCU | 2995 AD-26131, AD-26130 |
| 756 | GGACCAGGUGGU | 1601 ACCACCUGGUCC | 2996 AD-26132, AD-26131, AD-26130 |
| 757 | GACCAGGUGGUG | 1602 CACCACCUGGUC | 2997 AD-26132, AD-26133, AD-26131, AD-26130 |
| 758 | ACCAGGUGGUGG | 1603 CCACCACCUGGU | 2998 AD-26132, AD-26133, AD-26131, AD-26130, AD-26136 |
| 759 | CCAGGUGGUGGU | 1604 ACCACCACCUGG | 2999 AD-26132, AD-26131, AD-26136 |
| 760 | CAGGUGGUGGUU | 1605 AACCACCACCUG | 3000 AD-26132, AD-26133, AD-26131, AD-26136 |
| 761 | AGGUGGUGGUUA | 1606 UAACCACCACCU | 3001 AD-26132, AD-26131, AD-26130, AD-26136 |
| 762 | GGUGGUGGUUAA | 1607 UUAACCACCACC | 3002 AD-26132, AD-26131 |
| 763 | GUGGUGGUUAAU | 1608 AUUAACCACCAC | 3003 AD-26132, AD-26133, AD-26136 |
| 764 | UGGUGGUUAAUA | 1609 UAUUAACCACCA | 3004 AD-26133, AD-26136 |
| 784 | GUUAUGGUCCAU | 1610 AUGGACCAUAAC | 3005 AD-26138, AD-26137 |
| 787 | AUGGUCCAUCAG | 1611 CUGAUGGACCAU | 3006 AD-26138, AD-26139 |
| 788 | UGGUCCAUCAGC | 1612 GCUGAUGGACCA | 3007 AD-26138, AD-26139, AD-26140 |
| 789 | GGUCCAUCAGCU | 1613 AGCUGAUGGACC | 3008 AD-26142, AD-26140 |
| 790 | GUCCAUCAGCUU | 1614 AAGCUGAUGGAC | 3009 AD-26143, AD-26142, AD-26140 |
| 791 | UCCAUCAGCUUU | 1615 AAAGCUGAUGGA | 3010 AD-26139, AD-26143, AD-26142, AD-26140 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 792 | CCAUCAGCUUUC | 1616 | GAAAGCUGAUGG | 3011 | AD-26143, AD-26142, AD-26140 |
| 793 | CAUCAGCUUUCU | 1617 | AGAAAGCUGAUG | 3012 | AD-26139, AD-26143, AD-26142, AD-26140 |
| 794 | AUCAGCUUUCUA | 1618 | UAGAAAGCUGAU | 3013 | AD-26143, AD-26142, AD-26140 |
| 795 | UCAGCUUUCUAA | 1619 | UUAGAAAGCUGA | 3014 | AD-26143, AD-26142 |
| 796 | CAGCUUUCUAAA | 1620 | UUUAGAAAGCUG | 3015 | AD-26143, AD-26142 |
| 811 | GAAGCUUCCAGA | 1621 | UCUGGAAGCUUC | 3016 | AD-26144, AD-18950 |
| 812 | AAGCUUCCAGAC | 1622 | GUCUGGAAGCUU | 3017 | AD-26144, AD-18950 |
| 813 | AGCUUCCAGACA | 1623 | UGUCUGGAAGCU | 3018 | AD-26145, AD-26144, AD-18950 |
| 814 | GCUUCCAGACAC | 1624 | GUGUCUGGAAGC | 3019 | AD-26145, AD-26144 |
| 815 | CUUCCAGACACG | 1625 | CGUGUCUGGAAG | 3020 | AD-26145, AD-26144 |
| 816 | UUCCAGACACGC | 1626 | GCGUGUCUGGAA | 3021 | AD-26146, AD-26144 |
| 817 | UCCAGACACGCU | 1627 | AGCGUGUCUGGA | 3022 | AD-26145, AD-26146, AD-26144 |
| 818 | CCAGACACGCUA | 1628 | UAGCGUGUCUGG | 3023 | AD-26145, AD-26146 |
| 819 | CAGACACGCUAU | 1629 | AUAGCGUGUCUG | 3024 | AD-26145, AD-26146 |
| 820 | AGACACGCUAUC | 1630 | GAUAGCGUGUCU | 3025 | AD-26146, AD-26147 |
| 821 | GACACGCUAUCA | 1631 | UGAUAGCGUGUC | 3026 | AD-19745, AD-26146 |
| 822 | ACACGCUAUCAU | 1632 | AUGAUAGCGUGU | 3027 | AD-19745, AD-26146, AD-26147 |
| 823 | CACGCUAUCAUG | 1633 | CAUGAUAGCGUG | 3028 | AD-19745, AD-26147 |
| 824 | ACGCUAUCAUGC | 1634 | GCAUGAUAGCGU | 3029 | AD-19745, AD-19739, AD-26147 |
| 825 | CGCUAUCAUGCG | 1635 | CGCAUGAUAGCG | 3030 | AD-19745, AD-19746, AD-19739 |
| 826 | GCUAUCAUGCGU | 1636 | ACGCAUGAUAGC | 3031 | AD-19766, AD-19739, AD-26147 |
| 827 | CUAUCAUGCGUU | 1637 | AACGCAUGAUAG | 3032 | AD-19766, AD-19745, AD-19739, AD-26147 |
| 828 | UAUCAUGCGUUC | 1638 | GAACGCAUGAUA | 3033 | AD-19766, AD-19745, AD-19739 |
| 829 | AUCAUGCGUUCU | 1639 | AGAACGCAUGAU | 3034 | AD-19766, AD-19746, AD-19739 |
| 830 | UCAUGCGUUCUC | 1640 | GAGAACGCAUGA | 3035 | AD-19739, AD-26148 |
| 831 | CAUGCGUUCUCC | 1641 | GGAGAACGCAUG | 3036 | AD-19739, AD-26148 |
| 832 | AUGCGUUCUCCU | 1642 | AGGAGAACGCAU | 3037 | AD-19746, AD-26148 |
| 842 | CUCAGAUGGUGU | 1643 | ACACCAUCUGAG | 3038 | AD-26150, AD-26149 |
| 843 | UCAGAUGGUGUC | 1644 | GACACCAUCUGA | 3039 | AD-26150, AD-26149 |
| 844 | CAGAUGGUGUCU | 1645 | AGACACCAUCUG | 3040 | AD-26150, AD-26149 |
| 845 | AGAUGGUGUCUG | 1646 | CAGACACCAUCU | 3041 | AD-26150, AD-26149 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 846 | GAUGGUGUCUGC | 1647 | GCAGACACCAUC | 3042 | AD-26150, AD-26149 |
| 847 | AUGGUGUCUGCU | 1648 | AGCAGACACCAU | 3043 | AD-26150, AD-26149 |
| 848 | UGGUGUCUGCUA | 1649 | UAGCAGACACCA | 3044 | AD-26150, AD-26149 |
| 854 | CUGCUAUUGUAC | 1650 | GUACAAUAGCAG | 3045 | AD-26151, AD-26152 |
| 855 | UGCUAUUGUACG | 1651 | CGUACAAUAGCA | 3046 | AD-26151, AD-26152 |
| 856 | GCUAUUGUACGU | 1652 | ACGUACAAUAGC | 3047 | AD-26151, AD-26152 |
| 857 | CUAUUGUACGUA | 1653 | UACGUACAAUAG | 3048 | AD-26151, AD-26152 |
| 860 | UUGUACGUACCA | 1654 | UGGUACGUACAA | 3049 | AD-26153, AD-26152 |
| 861 | UGUACGUACCAU | 1655 | AUGGUACGUACA | 3050 | AD-26154, AD-26153, AD-26152 |
| 862 | GUACGUACCAUG | 1656 | CAUGGUACGUAC | 3051 | AD-26154, AD-26153 |
| 863 | UACGUACCAUGC | 1657 | GCAUGGUACGUA | 3052 | AD-26154, AD-26153 |
| 864 | ACGUACCAUGCA | 1658 | UGCAUGGUACGU | 3053 | AD-26154, AD-26153 |
| 865 | CGUACCAUGCAG | 1659 | CUGCAUGGUACG | 3054 | AD-26154, AD-26153 |
| 866 | GUACCAUGCAGA | 1660 | UCUGCAUGGUAC | 3055 | AD-26154, AD-26155 |
| 867 | UACCAUGCAGAA | 1661 | UUCUGCAUGGUA | 3056 | AD-26154, AD-26155, AD-26153 |
| 868 | ACCAUGCAGAAU | 1662 | AUUCUGCAUGGU | 3057 | AD-26154, AD-26155 |
| 870 | CAUGCAGAAUAC | 1663 | GUAUUCUGCAUG | 3058 | AD-26155, AD-26156 |
| 871 | AUGCAGAAUACA | 1664 | UGUAUUCUGCAU | 3059 | AD-26155, AD-26156 |
| 872 | UGCAGAAUACAA | 1665 | UUGUAUUCUGCA | 3060 | AD-26155, AD-26156 |
| 873 | GCAGAAUACAAA | 1666 | UUUGUAUUCUGC | 3061 | AD-26156, AD-26157 |
| 874 | CAGAAUACAAAU | 1667 | AUUUGUAUUCUG | 3062 | AD-19068, AD-26157 |
| 875 | AGAAUACAAAUG | 1668 | CAUUUGUAUUCU | 3063 | AD-19068, AD-26156 |
| 876 | GAAUACAAAUGA | 1669 | UCAUUUGUAUUC | 3064 | AD-19068, AD-26156, AD-26157 |
| 877 | AAUACAAAUGAU | 1670 | AUCAUUUGUAUU | 3065 | AD-19068, AD-26158, AD-26826, AD-26157 |
| 878 | AUACAAAUGAUG | 1671 | CAUCAUUUGUAU | 3066 | AD-19068, AD-26158, AD-26157 |
| 879 | UACAAAUGAUGU | 1672 | ACAUCAUUUGUA | 3067 | AD-26158, AD-26826, AD-26157 |
| 880 | ACAAAUGAUGUA | 1673 | UACAUCAUUUGU | 3068 | AD-19068, AD-26158, AD-26826, AD-26157 |
| 881 | CAAAUGAUGUAG | 1674 | CUACAUCAUUUG | 3069 | AD-19068, AD-26158, AD-26826 |
| 882 | AAAUGAUGUAGA | 1675 | UCUACAUCAUUU | 3070 | AD-26158, AD-26826 |
| 883 | AAUGAUGUAGAA | 1676 | UUCUACAUCAUU | 3071 | AD-26158, AD-26826 |
| 906 | UACCGCUGGGAC | 1677 | GUCCCAGCGGUA | 3072 | AD-26161, AD-26160 |
| 907 | ACCGCUGGGACC | 1678 | GGUCCCAGCGGU | 3073 | AD-26161, AD-26160 |
| 908 | CCGCUGGGACCU | 1679 | AGGUCCCAGCGG | 3074 | AD-26161, AD-26162 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 909 | CGCUGGGACCUU | 1680 | AAGGUCCCAGCG | 3075 | AD-26162, AD-26160 |
| 910 | GCUGGGACCUUG | 1681 | CAAGGUCCCAGC | 3076 | AD-26161, AD-26162 |
| 911 | CUGGGACCUUGC | 1682 | GCAAGGUCCCAG | 3077 | AD-26161, AD-26162 |
| 912 | UGGGACCUUGCA | 1683 | UGCAAGGUCCCA | 3078 | AD-26161, AD-26162, AD-26163 |
| 913 | GGGACCUUGCAU | 1684 | AUGCAAGGUCCC | 3079 | AD-26161, AD-26162, AD-26163, AD-26164 |
| 914 | GGACCUUGCAUA | 1685 | UAUGCAAGGUCC | 3080 | AD-26162, AD-26163, AD-26164 |
| 915 | GACCUUGCAUAA | 1686 | UUAUGCAAGGUC | 3081 | AD-19759, AD-26162, AD-26163, AD-26164 |
| 916 | ACCUUGCAUAAC | 1687 | GUUAUGCAAGGU | 3082 | AD-19759, AD-26163, AD-26164 |
| 917 | CCUUGCAUAACC | 1688 | GGUUAUGCAAGG | 3083 | AD-19759, AD-26164 |
| 918 | CUUGCAUAACCU | 1689 | AGGUUAUGCAAG | 3084 | AD-19759, AD-26163, AD-26164, AD-26165 |
| 919 | UUGCAUAACCUU | 1690 | AAGGUUAUGCAA | 3085 | AD-19759, AD-26163, AD-26164, AD-26165 |
| 920 | UGCAUAACCUUU | 1691 | AAAGGUUAUGCA | 3086 | AD-19759, AD-26164, AD-26165 |
| 921 | GCAUAACCUUUC | 1692 | GAAAGGUUAUGC | 3087 | AD-19759, AD-26165 |
| 922 | CAUAACCUUUCC | 1693 | GGAAAGGUUAUG | 3088 | AD-19759, AD-26165 |
| 959 | UCUUUAAGUCUG | 1694 | CAGACUUAAAGA | 3089 | AD-26166, AD-18901 |
| 960 | CUUUAAGUCUGG | 1695 | CCAGACUUAAAG | 3090 | AD-26166, AD-18901 |
| 975 | CAUUCCUGCCCU | 1696 | AGGGCAGGAAUG | 3091 | AD-26167, AD-26168 |
| 976 | AUUCCUGCCCUG | 1697 | CAGGGCAGGAAU | 3092 | AD-26167, AD-26168, AD-26169 |
| 977 | UUCCUGCCCUGG | 1698 | CCAGGGCAGGAA | 3093 | AD-26170, AD-26167, AD-26168, AD-26169 |
| 978 | UCCUGCCCUGGU | 1699 | ACCAGGGCAGGA | 3094 | AD-26170, AD-26168, AD-26169 |
| 979 | CCUGCCCUGGUG | 1700 | CACCAGGGCAGG | 3095 | AD-26170, AD-26168 |
| 980 | CUGCCCUGGUGA | 1701 | UCACCAGGGCAG | 3096 | AD-26170, AD-26167, AD-26169 |
| 981 | UGCCCUGGUGAA | 1702 | UUCACCAGGGCA | 3097 | AD-26170, AD-26167, AD-26171, AD-26168, AD-26169 |
| 982 | GCCCUGGUGAAA | 1703 | UUUCACCAGGGC | 3098 | AD-26170, AD-26171, AD-26168, AD-26169 |
| 983 | CCCUGGUGAAAA | 1704 | UUUUCACCAGGG | 3099 | AD-26170, AD-26171, AD-26169 |
| 984 | CCUGGUGAAAAU | 1705 | AUUUUCACCAGG | 3100 | AD-26170, AD-26171 |
| 985 | CUGGUGAAAAUG | 1706 | CAUUUUCACCAG | 3101 | AD-26172, AD-26171 |
| 986 | UGGUGAAAAUGC | 1707 | GCAUUUUCACCA | 3102 | AD-26172, AD-26171 |
| 987 | GGUGAAAAUGCU | 1708 | AGCAUUUUCACC | 3103 | AD-26172, AD-26171 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 988 | GUGAAAAUGCUU | 1709 | AAGCAUUUUCAC | 3104 | AD-26172, AD-26171 |
| 997 | CUUGGUUCACCA | 1710 | UGGUGAACCAAG | 3105 | AD-26173, AD-26174 |
| 998 | UUGGUUCACCAG | 1711 | CUGGUGAACCAA | 3106 | AD-26173, AD-26174 |
| 999 | UGGUUCACCAGU | 1712 | ACUGGUGAACCA | 3107 | AD-26173, AD-26174 |
| 1000 | GGUUCACCAGUG | 1713 | CACUGGUGAACC | 3108 | AD-26173, AD-26174 |
| 1001 | GUUCACCAGUGG | 1714 | CCACUGGUGAAC | 3109 | AD-26173, AD-26174 |
| 1002 | UUCACCAGUGGA | 1715 | UCCACUGGUGAA | 3110 | AD-26173, AD-26174 |
| 1003 | UCACCAGUGGAU | 1716 | AUCCACUGGUGA | 3111 | AD-26173, AD-26174 |
| 1004 | CACCAGUGGAUU | 1717 | AAUCCACUGGUG | 3112 | AD-26177, AD-26174 |
| 1007 | CAGUGGAUUCUG | 1718 | CAGAAUCCACUG | 3113 | AD-26177, AD-26178 |
| 1008 | AGUGGAUUCUGU | 1719 | ACAGAAUCCACU | 3114 | AD-26177, AD-26178, AD-26179 |
| 1009 | GUGGAUUCUGUG | 1720 | CACAGAAUCCAC | 3115 | AD-26177, AD-26178, AD-26179, AD-26180 |
| 1010 | UGGAUUCUGUGU | 1721 | ACACAGAAUCCA | 3116 | AD-26177, AD-26181, AD-26178, AD-26179, AD-26180 |
| 1011 | GGAUUCUGUGUU | 1722 | AACACAGAAUCC | 3117 | AD-26177, AD-26181, AD-26178, AD-26179, AD-26182, AD-26180 |
| 1012 | GAUUCUGUGUUG | 1723 | CAACACAGAAUC | 3118 | AD-26181, AD-26178, AD-26179, AD-26182, AD-26180 |
| 1013 | AUUCUGUGUUGU | 1724 | ACAACACAGAAU | 3119 | AD-26181, AD-26178, AD-26179, AD-26182 |
| 1014 | UUCUGUGUUGUU | 1725 | AACAACACAGAA | 3120 | AD-26181, AD-26179, AD-26182, AD-26180 |
| 1015 | UCUGUGUUGUUU | 1726 | AAACAACACAGA | 3121 | AD-26181, AD-26179, AD-26182, AD-26180 |
| 1016 | CUGUGUUGUUUU | 1727 | AAAACAACACAG | 3122 | AD-26181, AD-26182, AD-26180 |
| 1017 | UGUGUUGUUUUA | 1728 | UAAAACAACACA | 3123 | AD-26183, AD-26181, AD-26182 |
| 1018 | GUGUUGUUUUAU | 1729 | AUAAAACAACAC | 3124 | AD-26183, AD-26182, AD-26185 |
| 1019 | UGUUGUUUUAUG | 1730 | CAUAAAACAACA | 3125 | AD-26183, AD-26185 |
| 1020 | GUUGUUUUAUGC | 1731 | GCAUAAAACAAC | 3126 | AD-26183, AD-26185 |
| 1021 | UUGUUUUAUGCC | 1732 | GGCAUAAAACAA | 3127 | AD-26183, AD-26186 |
| 1022 | UGUUUUAUGCCA | 1733 | UGGCAUAAAACA | 3128 | AD-26183, AD-26185 |
| 1023 | GUUUUAUGCCAU | 1734 | AUGGCAUAAAAC | 3129 | AD-26183, AD-26185, AD-26186 |
| 1024 | UUUUAUGCCAUU | 1735 | AAUGGCAUAAAA | 3130 | AD-26183, AD-26185, AD-26186 |
| 1025 | UUUAUGCCAUUA | 1736 | UAAUGGCAUAAA | 3131 | AD-26185, AD-26186 |
| 1027 | UAUGCCAUUACA | 1737 | UGUAAUGGCAUA | 3132 | AD-26186, AD-19767 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1028 | AUGCCAUUACAA | 1738 | UUGUAAUGGCAU | 3133 | AD-26186, AD-19767 |
| 1031 | CCAUUACAACUC | 1739 | GAGUUGUAAUGG | 3134 | AD-26187, AD-19767 |
| 1032 | CAUUACAACUCU | 1740 | AGAGUUGUAAUG | 3135 | AD-26187, AD-19767 |
| 1033 | AUUACAACUCUC | 1741 | GAGAGUUGUAAU | 3136 | AD-26187, AD-19767 |
| 1034 | UUACAACUCUCC | 1742 | GGAGAGUUGUAA | 3137 | AD-26187, AD-19767 |
| 1035 | UACAACUCUCCA | 1743 | UGGAGAGUUGUA | 3138 | AD-26188, AD-26187 |
| 1036 | ACAACUCUCCAC | 1744 | GUGGAGAGUUGU | 3139 | AD-26188, AD-26189, AD-26187 |
| 1037 | CAACUCUCCACA | 1745 | UGUGGAGAGUUG | 3140 | AD-26190, AD-26188, AD-26189, AD-26187 |
| 1038 | AACUCUCCACAA | 1746 | UUGUGGAGAGUU | 3141 | AD-26190, AD-26191, AD-26188, AD-26189, AD-26187 |
| 1039 | ACUCUCCACAAC | 1747 | GUUGUGGAGAGU | 3142 | AD-26190, AD-26192, AD-26191, AD-26188, AD-26189 |
| 1040 | CUCUCCACAACC | 1748 | GGUUGUGGAGAG | 3143 | AD-26190, AD-26192, AD-26193, AD-26191, AD-26188, AD-26189 |
| 1041 | UCUCCACAACCU | 1749 | AGGUUGUGGAGA | 3144 | AD-26190, AD-26192, AD-26193, AD-26194, AD-26191, AD-26188, AD-26189 |
| 1042 | CUCCACAACCUU | 1750 | AAGGUUGUGGAG | 3145 | AD-26190, AD-26192, AD-26193, AD-26194, AD-26191, AD-26189 |
| 1043 | UCCACAACCUUU | 1751 | AAAGGUUGUGGA | 3146 | AD-26190, AD-26192, AD-26193, AD-26194, AD-26189 |
| 1044 | CCACAACCUUUU | 1752 | AAAAGGUUGUGG | 3147 | AD-26190, AD-26192, AD-26193, AD-26194, AD-26191 |
| 1045 | CACAACCUUUUA | 1753 | UAAAAGGUUGUG | 3148 | AD-26192, AD-26193, AD-26194, AD-26191 |
| 1046 | ACAACCUUUUAU | 1754 | AUAAAAGGUUGU | 3149 | AD-26192, AD-26193, AD-26194 |
| 1047 | CAACCUUUUAUU | 1755 | AAUAAAAGGUUG | 3150 | AD-26193, AD-26194, AD-26195 |
| 1048 | AACCUUUUAUUA | 1756 | UAAUAAAAGGUU | 3151 | AD-26194, AD-26195 |
| 1050 | CCUUUUAUUACA | 1757 | UGUAAUAAAAGG | 3152 | AD-26196, AD-26195 |
| 1051 | CUUUUAUUACAU | 1758 | AUGUAAUAAAAG | 3153 | AD-26196, AD-26195 |
| 1052 | UUUUAUUACAUC | 1759 | GAUGUAAUAAAA | 3154 | AD-26196, AD-26195 |
| 1053 | UUUAUUACAUCA | 1760 | UGAUGUAAUAAA | 3155 | AD-26196, AD-26195 |
| 1054 | UUAUUACAUCAA | 1761 | UUGAUGUAAUAA | 3156 | AD-26196, AD-26195 |
| 1057 | UUACAUCAAGAA | 1762 | UUCUUGAUGUAA | 3157 | AD-26197, AD-26196 |
| 1058 | UACAUCAAGAAG | 1763 | CUUCUUGAUGUA | 3158 | AD-26198, AD-26197 |
| 1059 | ACAUCAAGAAGG | 1764 | CCUUCUUGAUGU | 3159 | AD-26198, AD-26197 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1060 | CAUCAAGAAGGA | 1765 | UCCUUCUUGAUG | 3160 | AD-26198, AD-26199, AD-26197 |
| 1061 | AUCAAGAAGGAG | 1766 | CUCCUUCUUGAU | 3161 | AD-26198, AD-26199, AD-26197, AD-26200 |
| 1062 | UCAAGAAGGAGC | 1767 | GCUCCUUCUUGA | 3162 | AD-26198, AD-26199, AD-26200 |
| 1063 | CAAGAAGGAGCU | 1768 | AGCUCCUUCUUG | 3163 | AD-26198, AD-26197, AD-26200 |
| 1064 | AAGAAGGAGCUA | 1769 | UAGCUCCUUCUU | 3164 | AD-26198, AD-26199, AD-26197, AD-26200 |
| 1065 | AGAAGGAGCUAA | 1770 | UUAGCUCCUUCU | 3165 | AD-26198, AD-26199, AD-26200 |
| 1066 | GAAGGAGCUAAA | 1771 | UUUAGCUCCUUC | 3166 | AD-26199, AD-26200 |
| 1067 | AAGGAGCUAAAA | 1772 | UUUUAGCUCCUU | 3167 | AD-26199, AD-26200 |
| 1068 | AGGAGCUAAAAU | 1773 | AUUUUAGCUCCU | 3168 | AD-26200, AD-18977 |
| 1072 | GCUAAAAUGGCA | 1774 | UGCCAUUUUAGC | 3169 | AD-26201, AD-18977 |
| 1073 | CUAAAAUGGCAG | 1775 | CUGCCAUUUUAG | 3170 | AD-26201, AD-18977 |
| 1074 | UAAAAUGGCAGU | 1776 | ACUGCCAUUUUA | 3171 | AD-26201, AD-26202, AD-18977 |
| 1075 | AAAAUGGCAGUG | 1777 | CACUGCCAUUUU | 3172 | AD-26201, AD-18977 |
| 1076 | AAAUGGCAGUGC | 1778 | GCACUGCCAUUU | 3173 | AD-26201, AD-26202 |
| 1077 | AAUGGCAGUGCG | 1779 | CGCACUGCCAUU | 3174 | AD-26201, AD-26202 |
| 1078 | AUGGCAGUGCGU | 1780 | ACGCACUGCCAU | 3175 | AD-26201, AD-26202 |
| 1079 | UGGCAGUGCGUU | 1781 | AACGCACUGCCA | 3176 | AD-26201, AD-26202 |
| 1112 | UGGUUGCCUUGC | 1782 | GCAAGGCAACCA | 3177 | AD-26205, AD-26203 |
| 1113 | GGUUGCCUUGCU | 1783 | AGCAAGGCAACC | 3178 | AD-26206, AD-26205, AD-26203 |
| 1114 | GUUGCCUUGCUC | 1784 | GAGCAAGGCAAC | 3179 | AD-26206, AD-26205, AD-26203, AD-26207 |
| 1115 | UUGCCUUGCUCA | 1785 | UGAGCAAGGCAA | 3180 | AD-26206, AD-26205, AD-26203 |
| 1116 | UGCCUUGCUCAA | 1786 | UUGAGCAAGGCA | 3181 | AD-26206, AD-26203, AD-26207 |
| 1117 | GCCUUGCUCAAC | 1787 | GUUGAGCAAGGC | 3182 | AD-26205, AD-26208, AD-26207 |
| 1118 | CCUUGCUCAACA | 1788 | UGUUGAGCAAGG | 3183 | AD-26206, AD-26205, AD-26208, AD-26207, AD-26209 |
| 1119 | CUUGCUCAACAA | 1789 | UUGUUGAGCAAG | 3184 | AD-26206, AD-26205, AD-26208, AD-26207, AD-26209 |
| 1120 | UUGCUCAACAAA | 1790 | UUUGUUGAGCAA | 3185 | AD-26206, AD-26208, AD-26207, AD-26209 |
| 1121 | UGCUCAACAAAA | 1791 | UUUUGUUGAGCA | 3186 | AD-26208, AD-26207, AD-26209 |
| 1122 | GCUCAACAAAAC | 1792 | GUUUUGUUGAGC | 3187 | AD-26208, AD-26209 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1123 | CUCAACAAAACA | 1793 | UGUUUUGUUGAG | 3188 | AD-26208, AD-26209 |
| 1124 | UCAACAAAACAA | 1794 | UUGUUUUGUUGA | 3189 | AD-26208, AD-26209 |
| 1219 | AGUGGUGGACCC | 1795 | GGGUCCACCACU | 3190 | AD-26057, AD-26213 |
| 1220 | GUGGUGGACCCC | 1796 | GGGGUCCACCAC | 3191 | AD-26057, AD-26213, AD-26214 |
| 1221 | UGGUGGACCCCA | 1797 | UGGGGUCCACCA | 3192 | AD-26215, AD-26057, AD-26213, AD-26214 |
| 1222 | GGUGGACCCCAA | 1798 | UUGGGGUCCACC | 3193 | AD-26215, AD-26057, AD-26213 |
| 1223 | GUGGACCCCAAG | 1799 | CUUGGGGUCCAC | 3194 | AD-26215, AD-26213, AD-26214 |
| 1224 | UGGACCCCAAGC | 1800 | GCUUGGGGUCCA | 3195 | AD-26215, AD-26216, AD-26213, AD-26214 |
| 1225 | GGACCCCAAGCU | 1801 | AGCUUGGGGUCC | 3196 | AD-26215, AD-26217, AD-26216, AD-26213, AD-26214 |
| 1226 | GACCCCAAGCUU | 1802 | AAGCUUGGGGUC | 3197 | AD-26215, AD-26217, AD-26216, AD-26213, AD-26214, AD-26218 |
| 1227 | ACCCCAAGCUUU | 1803 | AAAGCUUGGGGU | 3198 | AD-26215, AD-26651, AD-26217, AD-26216, AD-26218 |
| 1228 | CCCCAAGCUUUA | 1804 | UAAAGCUUGGGG | 3199 | AD-26215, AD-26652, AD-26217, AD-26216, AD-26218 |
| 1229 | CCCAAGCUUUAG | 1805 | CUAAAGCUUGGG | 3200 | AD-26651, AD-26652, AD-26217, AD-26216, AD-26653, AD-26218 |
| 1230 | CCAAGCUUUAGU | 1806 | ACUAAAGCUUGG | 3201 | AD-26654, AD-26651, AD-26652, AD-26217, AD-26216, AD-26653, AD-26218 |
| 1231 | CAAGCUUUAGUA | 1807 | UACUAAAGCUUG | 3202 | AD-26654, AD-26651, AD-26652, AD-26217, AD-26068, AD-26216, AD-26653, AD-26218 |
| 1232 | AAGCUUUAGUAA | 1808 | UUACUAAAGCUU | 3203 | AD-26654, AD-26651, AD-26652, AD-26217, AD-26068, AD-26653, AD-26069, AD-26218 |
| 1233 | AGCUUUAGUAAA | 1809 | UUUACUAAAGCU | 3204 | AD-26654, AD-26651, AD-26652, AD-26068, AD-26653, AD-26069, AD-26218 |
| 1234 | GCUUUAGUAAAU | 1810 | AUUUACUAAAGC | 3205 | AD-26654, AD-26651, AD-26652, AD-26068, AD-26653, AD-26069 |
| 1235 | CUUUAGUAAAUA | 1811 | UAUUUACUAAAG | 3206 | AD-26654, AD-26652, AD-26068, AD-26653, AD-26069 |
| 1236 | UUUAGUAAAUAU | 1812 | AUAUUUACUAAA | 3207 | AD-26654, AD-26068, AD-26653, AD-26069 |

TABLE 4-continued

Groups of overlapping RNAi agents to Beta-Catenin

| Position | Sense overlap | SEQ ID NO: Anti-sense overlap | SEQ ID NO: | Overlapping groups of RNAi agents |
|---|---|---|---|---|
| 1237 | UUAGUAAUAUA | 1813 UAUAUUUACUAA | 3208 | AD-26654, AD-26068, AD-26069 |
| 1238 | UAGUAAAUAUAA | 1814 UUAUAUUUACUA | 3209 | AD-26068, AD-26069 |
| 1242 | AAAUAUAAUGAG | 1815 CUCAUUAUAUUU | 3210 | AD-26655, AD-26656 |
| 1243 | AAUAUAAUGAGG | 1816 CCUCAUUAUAUU | 3211 | AD-26655, AD-26657 |
| 1244 | AUAUAAUGAGGA | 1817 UCCUCAUUAUAU | 3212 | AD-26655, AD-26656, AD-26657 |
| 1245 | UAUAAUGAGGAC | 1818 GUCCUCAUUAUA | 3213 | AD-26655, AD-26656, AD-26657 |
| 1246 | AUAAUGAGGACC | 1819 GGUCCUCAUUAU | 3214 | AD-26655, AD-26656, AD-26657 |
| 1247 | UAAUGAGGACCU | 1820 AGGUCCUCAUUA | 3215 | AD-26658, AD-26655, AD-26656, AD-26657 |
| 1248 | AAUGAGGACCUA | 1821 UAGGUCCUCAUU | 3216 | AD-26658, AD-26655, AD-26657 |
| 1249 | AUGAGGACCUAU | 1822 AUAGGUCCUCAU | 3217 | AD-26658, AD-26656, AD-26657 |
| 1250 | UGAGGACCUAUA | 1823 UAUAGGUCCUCA | 3218 | AD-26658, AD-26657 |
| 1285 | ACAAGCAGAGUG | 1824 CACUCUGCUUGU | 3219 | AD-18945, AD-26660 |
| 1286 | CAAGCAGAGUGC | 1825 GCACUCUGCUUG | 3220 | AD-18945, AD-26660 |
| 1287 | AAGCAGAGUGCU | 1826 AGCACUCUGCUU | 3221 | AD-18945, AD-26660 |
| 1288 | AGCAGAGUGCUG | 1827 CAGCACUCUGCU | 3222 | AD-18945, AD-19046 |
| 1289 | GCAGAGUGCUGA | 1828 UCAGCACUCUGC | 3223 | AD-18945, AD-26660, AD-19046 |
| 1290 | CAGAGUGCUGAA | 1829 UUCAGCACUCUG | 3224 | AD-18945, AD-26660, AD-19046, AD-26661 |
| 1291 | AGAGUGCUGAAG | 1830 CUUCAGCACUCU | 3225 | AD-18945, AD-19046, AD-26661, AD-26662 |
| 1292 | GAGUGCUGAAGG | 1831 CCUUCAGCACUC | 3226 | AD-18945, AD-19046, AD-26662 |
| 1293 | AGUGCUGAAGGU | 1832 ACCUUCAGCACU | 3227 | AD-19046, AD-26661, AD-26662 |
| 1294 | GUGCUGAAGGUG | 1833 CACCUUCAGCAC | 3228 | AD-19046, AD-26662 |
| 1295 | UGCUGAAGGUGC | 1834 GCACCUUCAGCA | 3229 | AD-26661, AD-26662 |
| 1296 | GCUGAAGGUGCU | 1835 AGCACCUUCAGC | 3230 | AD-26661, AD-26662 |
| 1297 | CUGAAGGUGCUA | 1836 UAGCACCUUCAG | 3231 | AD-26661, AD-26662 |
| 1313 | UCUGCUCUAGUA | 1837 UACUAGAGCAGA | 3232 | AD-19768, AD-19748 |
| 1314 | CUGCUCUAGUAA | 1838 UUACUAGAGCAG | 3233 | AD-19768, AD-19748 |
| 1315 | UGCUCUAGUAAU | 1839 AUUACUAGAGCA | 3234 | AD-19768, AD-19748 |
| 1316 | GCUCUAGUAAUA | 1840 UAUUACUAGAGC | 3235 | AD-19768, AD-19748 |
| 1317 | CUCUAGUAAUAA | 1841 UUAUUACUAGAG | 3236 | AD-19768, AD-19748 |
| 1318 | UCUAGUAAUAAG | 1842 CUUAUUACUAGA | 3237 | AD-19768, AD-19748 |
| 1319 | CUAGUAAUAAGC | 1843 GCUUAUUACUAG | 3238 | AD-19768, AD-19748 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1337 | UUGUAGAAGCUG | 1844 | CAGCUUCUACAA | 3239 | AD-26664, AD-26663 |
| 1338 | UGUAGAAGCUGG | 1845 | CCAGCUUCUACA | 3240 | AD-26664, AD-26663 |
| 1339 | GUAGAAGCUGGU | 1846 | ACCAGCUUCUAC | 3241 | AD-26664, AD-26663 |
| 1340 | UAGAAGCUGGUG | 1847 | CACCAGCUUCUA | 3242 | AD-26664, AD-26663 |
| 1341 | AGAAGCUGGUGG | 1848 | CCACCAGCUUCU | 3243 | AD-26664, AD-26663 |
| 1342 | GAAGCUGGUGGA | 1849 | UCCACCAGCUUC | 3244 | AD-26664, AD-26663 |
| 1343 | AAGCUGGUGGAA | 1850 | UUCCACCAGCUU | 3245 | AD-26664, AD-26663 |
| 1346 | CUGGUGGAAUGC | 1851 | GCAUUCCACCAG | 3246 | AD-26665, AD-26666 |
| 1347 | UGGUGGAAUGCA | 1852 | UGCAUUCCACCA | 3247 | AD-26665, AD-26666 |
| 1348 | GGUGGAAUGCAA | 1853 | UUGCAUUCCACC | 3248 | AD-26665, AD-26666 |
| 1349 | GUGGAAUGCAAG | 1854 | CUUGCAUUCCAC | 3249 | AD-26665, AD-26666 |
| 1350 | UGGAAUGCAAGC | 1855 | GCUUGCAUUCCA | 3250 | AD-26665, AD-26666 |
| 1351 | GGAAUGCAAGCU | 1856 | AGCUUGCAUUCC | 3251 | AD-26665, AD-26666 |
| 1352 | GAAUGCAAGCUU | 1857 | AAGCUUGCAUUC | 3252 | AD-26665, AD-26666 |
| 1369 | CUUCACCUGACA | 1858 | UGUCAGGUGAAG | 3253 | AD-26667, AD-26668 |
| 1370 | UUCACCUGACAG | 1859 | CUGUCAGGUGAA | 3254 | AD-26667, AD-26668 |
| 1371 | UCACCUGACAGA | 1860 | UCUGUCAGGUGA | 3255 | AD-26667, AD-26668 |
| 1372 | CACCUGACAGAU | 1861 | AUCUGUCAGGUG | 3256 | AD-26667, AD-26668 |
| 1374 | CCUGACAGAUCC | 1862 | GGAUCUGUCAGG | 3257 | AD-26669, AD-26668 |
| 1375 | CUGACAGAUCCA | 1863 | UGGAUCUGUCAG | 3258 | AD-26669, AD-26668 |
| 1376 | UGACAGAUCCAA | 1864 | UUGGAUCUGUCA | 3259 | AD-26669, AD-26668 |
| 1380 | AGAUCCAAGUCA | 1865 | UGACUUGGAUCU | 3260 | AD-26669, AD-26670 |
| 1381 | GAUCCAAGUCAA | 1866 | UUGACUUGGAUC | 3261 | AD-26669, AD-26670 |
| 1383 | UCCAAGUCAACG | 1867 | CGUUGACUUGGA | 3262 | AD-26671, AD-26670 |
| 1384 | CCAAGUCAACGU | 1868 | ACGUUGACUUGG | 3263 | AD-26671, AD-26670 |
| 1385 | CAAGUCAACGUC | 1869 | GACGUUGACUUG | 3264 | AD-26671, AD-26670 |
| 1386 | AAGUCAACGUCU | 1870 | AGACGUUGACUU | 3265 | AD-26671, AD-26670 |
| 1387 | AGUCAACGUCUU | 1871 | AAGACGUUGACU | 3266 | AD-26671, AD-26670 |
| 1396 | CUUGUUCAGAAC | 1872 | GUUCUGAACAAG | 3267 | AD-26672, AD-26673 |
| 1397 | UUGUUCAGAACU | 1873 | AGUUCUGAACAA | 3268 | AD-26672, AD-26673 |
| 1398 | UGUUCAGAACUG | 1874 | CAGUUCUGAACA | 3269 | AD-26672, AD-26673 |
| 1399 | GUUCAGAACUGU | 1875 | ACAGUUCUGAAC | 3270 | AD-26672, AD-26673 |
| 1400 | UUCAGAACUGUC | 1876 | GACAGUUCUGAA | 3271 | AD-26672, AD-26673 |
| 1401 | UCAGAACUGUCU | 1877 | AGACAGUUCUGA | 3272 | AD-26672, AD-26673 |
| 1402 | CAGAACUGUCUU | 1878 | AAGACAGUUCUG | 3273 | AD-26672, AD-26673 |
| 1406 | ACUGUCUUUGGA | 1879 | UCCAAAGACAGU | 3274 | AD-19056, AD-19079 |
| 1407 | CUGUCUUUGGAC | 1880 | GUCCAAAGACAG | 3275 | AD-19056, AD-19079 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1408 | UGUCUUUGGACU | 1881 | AGUCCAAAGACA | 3276 | AD-19056, AD-19079 |
| 1409 | GUCUUUGGACUC | 1882 | GAGUCCAAAGAC | 3277 | AD-26674, AD-19056, AD-19079 |
| 1410 | UCUUUGGACUCU | 1883 | AGAGUCCAAAGA | 3278 | AD-26674, AD-26675, AD-19056, AD-19079 |
| 1411 | CUUUGGACUCUC | 1884 | GAGAGUCCAAAG | 3279 | AD-26674, AD-19056, AD-19079 |
| 1412 | UUUGGACUCUCA | 1885 | UGAGAGUCCAAA | 3280 | AD-26674, AD-26675, AD-19079 |
| 1413 | UUGGACUCUCAG | 1886 | CUGAGAGUCCAA | 3281 | AD-26675, AD-26676, AD-19079 |
| 1414 | UGGACUCUCAGG | 1887 | CCUGAGAGUCCA | 3282 | AD-26674, AD-26675, AD-26676, AD-26678 |
| 1415 | GGACUCUCAGGA | 1888 | UCCUGAGAGUCC | 3283 | AD-26674, AD-26676, AD-26678 |
| 1416 | GACUCUCAGGAA | 1889 | UUCCUGAGAGUC | 3284 | AD-26674, AD-26675, AD-26676, AD-26678 |
| 1417 | ACUCUCAGGAAU | 1890 | AUUCCUGAGAGU | 3285 | AD-26675, AD-26676, AD-26678 |
| 1418 | CUCUCAGGAAUC | 1891 | GAUUCCUGAGAG | 3286 | AD-26676, AD-26678 |
| 1419 | UCUCAGGAAUCU | 1892 | AGAUUCCUGAGA | 3287 | AD-26679, AD-26676, AD-26678 |
| 1420 | CUCAGGAAUCUU | 1893 | AAGAUUCCUGAG | 3288 | AD-26679, AD-26678 |
| 1421 | UCAGGAAUCUUU | 1894 | AAAGAUUCCUGA | 3289 | AD-26679, AD-26678 |
| 1426 | AAUCUUUCAGAU | 1895 | AUCUGAAAGAUU | 3290 | AD-26679, AD-26680 |
| 1429 | CUUUCAGAUGCU | 1896 | AGCAUCUGAAAG | 3291 | AD-26681, AD-26680 |
| 1430 | UUUCAGAUGCUG | 1897 | CAGCAUCUGAAA | 3292 | AD-26681, AD-26680 |
| 1431 | UUCAGAUGCUGC | 1898 | GCAGCAUCUGAA | 3293 | AD-26682, AD-26680 |
| 1432 | UCAGAUGCUGCA | 1899 | UGCAGCAUCUGA | 3294 | AD-26682, AD-26681 |
| 1433 | CAGAUGCUGCAA | 1900 | UUGCAGCAUCUG | 3295 | AD-26682, AD-26681, AD-26680 |
| 1434 | AGAUGCUGCAAC | 1901 | GUUGCAGCAUCU | 3296 | AD-26682, AD-26681 |
| 1435 | GAUGCUGCAACU | 1902 | AGUUGCAGCAUC | 3297 | AD-26682, AD-26681 |
| 1436 | AUGCUGCAACUA | 1903 | UAGUUGCAGCAU | 3298 | AD-26682, AD-26681 |
| 1437 | UGCUGCAACUAA | 1904 | UUAGUUGCAGCA | 3299 | AD-26682, AD-26683 |
| 1438 | GCUGCAACUAAA | 1905 | UUUAGUUGCAGC | 3300 | AD-26682, AD-26683 |
| 1467 | UCUCCUUGGGAC | 1906 | GUCCCAAGGAGA | 3301 | AD-26687, AD-26686 |
| 1468 | CUCCUUGGGACU | 1907 | AGUCCCAAGGAG | 3302 | AD-26687, AD-26686 |
| 1469 | UCCUUGGGACUC | 1908 | GAGUCCCAAGGA | 3303 | AD-26687, AD-26686 |
| 1470 | CCUUGGGACUCU | 1909 | AGAGUCCCAAGG | 3304 | AD-26687, AD-26686 |
| 1471 | CUUGGGACUCUU | 1910 | AAGAGUCCCAAG | 3305 | AD-26687, AD-26686 |
| 1473 | UGGGACUCUUGU | 1911 | ACAAGAGUCCCA | 3306 | AD-26688, AD-26687 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1474 | GGGACUCUUGUU | 1912 | AACAAGAGUCCC | 3307 | AD-26688, AD-26687 |
| 1480 | CUUGUUCAGCUU | 1913 | AAGCUGAACAAG | 3308 | AD-26689, AD-26688 |
| 1485 | UCAGCUUCUGGG | 1914 | CCCAGAAGCUGA | 3309 | AD-26689, AD-26690 |
| 1486 | CAGCUUCUGGGU | 1915 | ACCCAGAAGCUG | 3310 | AD-26689, AD-26690 |
| 1487 | AGCUUCUGGGUU | 1916 | AACCCAGAAGCU | 3311 | AD-26689, AD-26690 |
| 1488 | GCUUCUGGGUUC | 1917 | GAACCCAGAAGC | 3312 | AD-26691, AD-26690 |
| 1489 | CUUCUGGGUUCA | 1918 | UGAACCCAGAAG | 3313 | AD-26692, AD-26691, AD-26690 |
| 1490 | UUCUGGGUUCAG | 1919 | CUGAACCCAGAA | 3314 | AD-26692, AD-26691, AD-26694, AD-26690 |
| 1491 | UCUGGGUUCAGA | 1920 | UCUGAACCCAGA | 3315 | AD-26692, AD-26694, AD-26690 |
| 1492 | CUGGGUUCAGAU | 1921 | AUCUGAACCCAG | 3316 | AD-26692, AD-26691, AD-26694, AD-26695, AD-26690 |
| 1493 | UGGGUUCAGAUG | 1922 | CAUCUGAACCCA | 3317 | AD-26692, AD-26691, AD-26696, AD-26694, AD-26695 |
| 1494 | GGGUUCAGAUGA | 1923 | UCAUCUGAACCC | 3318 | AD-26692, AD-26691, AD-26696, AD-26694 |
| 1495 | GGUUCAGAUGAU | 1924 | AUCAUCUGAACC | 3319 | AD-26692, AD-26691, AD-26694, AD-26695 |
| 1496 | GUUCAGAUGAUA | 1925 | UAUCAUCUGAAC | 3320 | AD-26696, AD-26694, AD-26695 |
| 1497 | UUCAGAUGAUAU | 1926 | AUAUCAUCUGAA | 3321 | AD-26696, AD-26694, AD-26695 |
| 1498 | UCAGAUGAUAUA | 1927 | UAUAUCAUCUGA | 3322 | AD-26696, AD-26695 |
| 1499 | CAGAUGAUAUAA | 1928 | UUAUAUCAUCUG | 3323 | AD-26696, AD-26695 |
| 1503 | UGAUAUAAAUGU | 1929 | ACAUUUAUAUCA | 3324 | AD-18994, AD-18927 |
| 1504 | GAUAUAAAUGUG | 1930 | CACAUUUAUAUC | 3325 | AD-19045, AD-18994 |
| 1505 | AUAUAAAUGUGG | 1931 | CCACAUUUAUAU | 3326 | AD-19045, AD-18927 |
| 1506 | UAUAAAUGUGGU | 1932 | ACCACAUUUAUA | 3327 | AD-18994, AD-18927 |
| 1507 | AUAAAUGUGGUC | 1933 | GACCACAUUUAU | 3328 | AD-19045, AD-18994, AD-18927 |
| 1508 | UAAAUGUGGUCA | 1934 | UGACCACAUUUA | 3329 | AD-19045, AD-18994, AD-18927 |
| 1509 | AAAUGUGGUCAC | 1935 | GUGACCACAUUU | 3330 | AD-19045, AD-18994 |
| 1510 | AAUGUGGUCACC | 1936 | GGUGACCACAUU | 3331 | AD-19045, AD-18994 |
| 1517 | UCACCUGUGCAG | 1937 | CUGCACAGGUGA | 3332 | AD-26697, AD-26698 |
| 1518 | CACCUGUGCAGC | 1938 | GCUGCACAGGUG | 3333 | AD-26697, AD-26698 |
| 1519 | ACCUGUGCAGCU | 1939 | AGCUGCACAGGU | 3334 | AD-26697, AD-26699 |
| 1520 | CCUGUGCAGCUG | 1940 | CAGCUGCACAGG | 3335 | AD-26697, AD-26699, AD-26698 |
| 1521 | CUGUGCAGCUGG | 1941 | CCAGCUGCACAG | 3336 | AD-26700, AD-26697, AD-26699, AD-26698 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1522 | UGUGCAGCUGGA | 1942 | UCCAGCUGCACA | 3337 | AD-26700, AD-26697, AD-26699, AD-26701, AD-26698 |
| 1523 | GUGCAGCUGGAA | 1943 | UUCCAGCUGCAC | 3338 | AD-26700, AD-26699, AD-26701, AD-26698 |
| 1524 | UGCAGCUGGAAU | 1944 | AUUCCAGCUGCA | 3339 | AD-26700, AD-26699, AD-26701, AD-26698 |
| 1525 | GCAGCUGGAAUU | 1945 | AAUUCCAGCUGC | 3340 | AD-26700, AD-26699, AD-26701, AD-26702 |
| 1526 | CAGCUGGAAUUC | 1946 | GAAUUCCAGCUG | 3341 | AD-26700, AD-26701, AD-26702 |
| 1527 | AGCUGGAAUUCU | 1947 | AGAAUUCCAGCU | 3342 | AD-26700, AD-26703, AD-26702 |
| 1528 | GCUGGAAUUCUU | 1948 | AAGAAUUCCAGC | 3343 | AD-26700, AD-26703, AD-26701, AD-26702 |
| 1529 | CUGGAAUUCUUU | 1949 | AAAGAAUUCCAG | 3344 | AD-26703, AD-26701, AD-26702 |
| 1530 | UGGAAUUCUUUC | 1950 | GAAAGAAUUCCA | 3345 | AD-26703, AD-26702 |
| 1531 | GGAAUUCUUUCU | 1951 | AGAAAGAAUUCC | 3346 | AD-26703, AD-26702 |
| 1532 | GAAUUCUUUCUA | 1952 | UAGAAAGAAUUC | 3347 | AD-26703, AD-26702 |
| 1538 | UUUCUAACCUCA | 1953 | UGAGGUUAGAAA | 3348 | AD-26704, AD-26920 |
| 1539 | UUCUAACCUCAC | 1954 | GUGAGGUUAGAA | 3349 | AD-26704, AD-26920, AD-26705 |
| 1540 | UCUAACCUCACU | 1955 | AGUGAGGUUAGA | 3350 | AD-26704, AD-26920, AD-26705, AD-18899 |
| 1541 | CUAACCUCACUU | 1956 | AAGUGAGGUUAG | 3351 | AD-26704, AD-26920, AD-26705, AD-18899, AD-18917 |
| 1542 | UAACCUCACUUG | 1957 | CAAGUGAGGUUA | 3352 | AD-26704, AD-26705, AD-18899, AD-18917 |
| 1543 | AACCUCACUUGC | 1958 | GCAAGUGAGGUU | 3353 | AD-26704, AD-19074, AD-26705, AD-18899, AD-18917 |
| 1544 | ACCUCACUUGCA | 1959 | UGCAAGUGAGGU | 3354 | AD-26704, AD-26706, AD-19074, AD-26705, AD-18899, AD-18917 |
| 1545 | CCUCACUUGCAA | 1960 | UUGCAAGUGAGG | 3355 | AD-26704, AD-26706, AD-26707, AD-19074, AD-26705, AD-18899, AD-18917 |
| 1546 | CUCACUUGCAAU | 1961 | AUUGCAAGUGAG | 3356 | AD-26706, AD-26707, AD-19074, AD-26708, AD-26705, AD-18899, AD-18917 |
| 1547 | UCACUUGCAAUA | 1962 | UAUUGCAAGUGA | 3357 | AD-26706, AD-26134, AD-26707, AD-19074, AD-26708, AD-18899, AD-18917 |
| 1548 | CACUUGCAAUAA | 1963 | UUAUUGCAAGUG | 3358 | AD-26706, AD-26134, AD-26707, AD-19074, AD-26708, AD-18917 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1549 | ACUUGCAAUAAU | 1964 | AUUAUUGCAAGU | 3359 | AD-26706, AD-26134, AD-26707, AD-19074, AD-26708 |
| 1550 | CUUGCAAUAAUU | 1965 | AAUUAUUGCAAG | 3360 | AD-26706, AD-26134, AD-26707, AD-19074, AD-26708, AD-26135 |
| 1551 | UUGCAAUAAUUA | 1966 | UAAUUAUUGCAA | 3361 | AD-26706, AD-26134, AD-26707, AD-26708, AD-26135 |
| 1552 | UGCAAUAAUUAU | 1967 | AUAAUUAUUGCA | 3362 | AD-26134, AD-26707, AD-26708, AD-26135 |
| 1553 | GCAAUAAUUAUA | 1968 | UAUAAUUAUUGC | 3363 | AD-26134, AD-26708, AD-26135 |
| 1554 | CAAUAAUUAUAA | 1969 | UUAUAAUUAUUG | 3364 | AD-26134, AD-26135 |
| 1580 | UCUGCCAAGUGG | 1970 | CCACUUGGCAGA | 3365 | AD-26710, AD-26709 |
| 1581 | CUGCCAAGUGGG | 1971 | CCCACUUGGCAG | 3366 | AD-26710, AD-26709 |
| 1582 | UGCCAAGUGGGU | 1972 | ACCCACUUGGCA | 3367 | AD-26710, AD-26709 |
| 1583 | GCCAAGUGGGUG | 1973 | CACCCACUUGGC | 3368 | AD-26710, AD-26709 |
| 1584 | CCAAGUGGGUGG | 1974 | CCACCCACUUGG | 3369 | AD-26710, AD-26709 |
| 1585 | CAAGUGGGUGGU | 1975 | ACCACCCACUUG | 3370 | AD-26710, AD-26709 |
| 1586 | AAGUGGGUGGUA | 1976 | UACCACCCACUU | 3371 | AD-26710, AD-26709 |
| 1597 | AUAGAGGCUCUU | 1977 | AAGAGCCUCUAU | 3372 | AD-26712, AD-26711 |
| 1628 | CUGGUGACAGGG | 1978 | CCCUGUCACCAG | 3373 | AD-26714, AD-26141 |
| 1629 | UGGUGACAGGGA | 1979 | UCCCUGUCACCA | 3374 | AD-26714, AD-26141 |
| 1630 | GGUGACAGGGAA | 1980 | UUCCCUGUCACC | 3375 | AD-26714, AD-26141 |
| 1637 | GGGAAGACAUCA | 1981 | UGAUGUCUUCCC | 3376 | AD-18938, AD-19064 |
| 1638 | GGAAGACAUCAC | 1982 | GUGAUGUCUUCC | 3377 | AD-18938, AD-18937 |
| 1639 | GAAGACAUCACU | 1983 | AGUGAUGUCUUC | 3378 | AD-18938, AD-19064 |
| 1640 | AAGACAUCACUG | 1984 | CAGUGAUGUCUU | 3379 | AD-19064, AD-18937 |
| 1641 | AGACAUCACUGA | 1985 | UCAGUGAUGUCU | 3380 | AD-18938, AD-19064, AD-18937 |
| 1642 | GACAUCACUGAG | 1986 | CUCAGUGAUGUC | 3381 | AD-18938, AD-19064, AD-18937 |
| 1643 | ACAUCACUGAGC | 1987 | GCUCAGUGAUGU | 3382 | AD-18938, AD-19064, AD-18937, AD-26715 |
| 1644 | CAUCACUGAGCC | 1988 | GGCUCAGUGAUG | 3383 | AD-18938, AD-18937, AD-26715 |
| 1645 | AUCACUGAGCCU | 1989 | AGGCUCAGUGAU | 3384 | AD-18937, AD-26715 |
| 1654 | CCUGCCAUCUGU | 1990 | ACAGAUGGCAGG | 3385 | AD-26716, AD-18990 |
| 1655 | CUGCCAUCUGUG | 1991 | CACAGAUGGCAG | 3386 | AD-26716, AD-18990 |
| 1656 | UGCCAUCUGUGC | 1992 | GCACAGAUGGCA | 3387 | AD-26716, AD-18990 |
| 1657 | GCCAUCUGUGCU | 1993 | AGCACAGAUGGC | 3388 | AD-26716, AD-18990, AD-19061 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1658 | CCAUCUGUGCUC | 1994 | GAGCACAGAUGG | 3389 | AD-26716, AD-18990, AD-18893, AD-19061 |
| 1659 | CAUCUGUGCUCU | 1995 | AGAGCACAGAUG | 3390 | AD-26716, AD-18946, AD-18990, AD-18893, AD-19061 |
| 1660 | AUCUGUGCUCUU | 1996 | AAGAGCACAGAU | 3391 | AD-26716, AD-18946, AD-18990, AD-19082, AD-18893, AD-19061 |
| 1661 | UCUGUGCUCUUC | 1997 | GAAGAGCACAGA | 3392 | AD-18946, AD-18990, AD-19082, AD-18893, AD-19061 |
| 1662 | CUGUGCUCUUCG | 1998 | CGAAGAGCACAG | 3393 | AD-18946, AD-19082, AD-19061 |
| 1663 | UGUGCUCUUCGU | 1999 | ACGAAGAGCACA | 3394 | AD-18946, AD-19082, AD-18893, AD-19061 |
| 1664 | GUGCUCUUCGUC | 2000 | GACGAAGAGCAC | 3395 | AD-18946, AD-18904, AD-19082, AD-18893, AD-19061 |
| 1665 | UGCUCUUCGUCA | 2001 | UGACGAAGAGCA | 3396 | AD-18946, AD-18904, AD-19082, AD-18893 |
| 1666 | GCUCUUCGUCAU | 2002 | AUGACGAAGAGC | 3397 | AD-18946, AD-18932, AD-18904, AD-19082 |
| 1667 | CUCUUCGUCAUC | 2003 | GAUGACGAAGAG | 3398 | AD-18932, AD-19082, AD-18943 |
| 1668 | UCUUCGUCAUCU | 2004 | AGAUGACGAAGA | 3399 | AD-18932, AD-18904, AD-18943 |
| 1669 | CUUCGUCAUCUG | 2005 | CAGAUGACGAAG | 3400 | AD-18904, AD-19002, AD-18943 |
| 1670 | UUCGUCAUCUGA | 2006 | UCAGAUGACGAA | 3401 | AD-18932, AD-18904, AD-19002, AD-18943 |
| 1671 | UCGUCAUCUGAC | 2007 | GUCAGAUGACGA | 3402 | AD-18904, AD-18943 |
| 1672 | CGUCAUCUGACC | 2008 | GGUCAGAUGACG | 3403 | AD-18932, AD-19002, AD-18943 |
| 1673 | GUCAUCUGACCA | 2009 | UGGUCAGAUGAC | 3404 | AD-18932, AD-18943 |
| 1674 | UCAUCUGACCAG | 2010 | CUGGUCAGAUGA | 3405 | AD-19002, AD-18943 |
| 1677 | UCUGACCAGCCG | 2011 | CGGCUGGUCAGA | 3406 | AD-26717, AD-19761 |
| 1678 | CUGACCAGCCGA | 2012 | UCGGCUGGUCAG | 3407 | AD-26717, AD-19761 |
| 1679 | UGACCAGCCGAC | 2013 | GUCGGCUGGUCA | 3408 | AD-26717, AD-19761 |
| 1680 | GACCAGCCGACA | 2014 | UGUCGGCUGGUC | 3409 | AD-26717, AD-19761 |
| 1681 | ACCAGCCGACAC | 2015 | GUGUCGGCUGGU | 3410 | AD-26717, AD-26718 |
| 1682 | CCAGCCGACACC | 2016 | GGUGUCGGCUGG | 3411 | AD-26717, AD-26718, AD-19761 |
| 1683 | CAGCCGACACCA | 2017 | UGGUGUCGGCUG | 3412 | AD-26717, AD-26718, AD-19761 |
| 1684 | AGCCGACACCAA | 2018 | UUGGUGUCGGCU | 3413 | AD-26717, AD-26718 |
| 1704 | GAUGGCCCAGAA | 2019 | UUCUGGGCCAUC | 3414 | AD-26721, AD-26720 |
| 1705 | AUGGCCCAGAAU | 2020 | AUUCUGGGCCAU | 3415 | AD-26721, AD-26720 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1710 | CCAGAAUGCAGU | 2021 | ACUGCAUUCUGG | 3416 | AD-26721, AD-26722 |
| 1711 | CAGAAUGCAGUU | 2022 | AACUGCAUUCUG | 3417 | AD-26721, AD-26722 |
| 1713 | GAAUGCAGUUCG | 2023 | CGAACUGCAUUC | 3418 | AD-26722, AD-19741 |
| 1714 | AAUGCAGUUCGC | 2024 | GCGAACUGCAUU | 3419 | AD-26722, AD-19741 |
| 1715 | AUGCAGUUCGCC | 2025 | GGCGAACUGCAU | 3420 | AD-26722, AD-19741, AD-26723 |
| 1716 | UGCAGUUCGCCU | 2026 | AGGCGAACUGCA | 3421 | AD-26724, AD-26722, AD-19741, AD-26723 |
| 1717 | GCAGUUCGCCUU | 2027 | AAGGCGAACUGC | 3422 | AD-26724, AD-19741, AD-26723 |
| 1718 | CAGUUCGCCUUC | 2028 | GAAGGCGAACUG | 3423 | AD-26724, AD-26723 |
| 1719 | AGUUCGCCUUCA | 2029 | UGAAGGCGAACU | 3424 | AD-26724, AD-19741 |
| 1720 | GUUCGCCUUCAC | 2030 | GUGAAGGCGAAC | 3425 | AD-19741, AD-26723 |
| 1721 | UUCGCCUUCACU | 2031 | AGUGAAGGCGAA | 3426 | AD-26724, AD-26723 |
| 1722 | UCGCCUUCACUA | 2032 | UAGUGAAGGCGA | 3427 | AD-26724, AD-26725, AD-26723 |
| 1723 | CGCCUUCACUAU | 2033 | AUAGUGAAGGCG | 3428 | AD-26724, AD-26725 |
| 1728 | UCACUAUGGACU | 2034 | AGUCCAUAGUGA | 3429 | AD-26725, AD-26726 |
| 1729 | CACUAUGGACUA | 2035 | UAGUCCAUAGUG | 3430 | AD-26725, AD-26726 |
| 1734 | UGGACUACCAGU | 2036 | ACUGGUAGUCCA | 3431 | AD-26727, AD-26726 |
| 1735 | GGACUACCAGUU | 2037 | AACUGGUAGUCC | 3432 | AD-26727, AD-26728 |
| 1736 | GACUACCAGUUG | 2038 | CAACUGGUAGUC | 3433 | AD-26728, AD-26729 |
| 1737 | ACUACCAGUUGU | 2039 | ACAACUGGUAGU | 3434 | AD-26727, AD-26729 |
| 1738 | CUACCAGUUGUG | 2040 | CACAACUGGUAG | 3435 | AD-26727, AD-26728, AD-26729 |
| 1739 | UACCAGUUGUGG | 2041 | CCACAACUGGUA | 3436 | AD-26727, AD-26728, AD-26729 |
| 1740 | ACCAGUUGUGGU | 2042 | ACCACAACUGGU | 3437 | AD-26727, AD-26728, AD-26729 |
| 1741 | CCAGUUGUGGUU | 2043 | AACCACAACUGG | 3438 | AD-26727, AD-26728, AD-26729 |
| 1742 | CAGUUGUGGUUA | 2044 | UAACCACAACUG | 3439 | AD-26728, AD-26730, AD-26729 |
| 1743 | AGUUGUGGUUAA | 2045 | UUAACCACAACU | 3440 | AD-26731, AD-26730, AD-26729 |
| 1744 | GUUGUGGUUAAG | 2046 | CUUAACCACAAC | 3441 | AD-26731, AD-26730 |
| 1745 | UUGUGGUUAAGC | 2047 | GCUUAACCACAA | 3442 | AD-26731, AD-26730 |
| 1746 | UGUGGUUAAGCU | 2048 | AGCUUAACCACA | 3443 | AD-26731, AD-26730 |
| 1747 | GUGGUUAAGCUC | 2049 | GAGCUUAACCAC | 3444 | AD-26731, AD-26730 |
| 1748 | UGGUUAAGCUCU | 2050 | AGAGCUUAACCA | 3445 | AD-26731, AD-26730 |
| 1749 | GGUUAAGCUCUU | 2051 | AAGAGCUUAACC | 3446 | AD-26731, AD-26730 |
| 1770 | AUCCCACUGGCC | 2052 | GGCCAGUGGGAU | 3447 | AD-26734, AD-26733 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1771 | UCCCACUGGCCU | 2053 | AGGCCAGUGGGA | 3448 | AD-26734, AD-26733, AD-26735 |
| 1772 | CCCACUGGCCUC | 2054 | GAGGCCAGUGGG | 3449 | AD-26734, AD-18963, AD-26733, AD-26735 |
| 1773 | CCACUGGCCUCU | 2055 | AGAGGCCAGUGG | 3450 | AD-26734, AD-18930, AD-18963, AD-26733, AD-26735 |
| 1774 | CACUGGCCUCUG | 2056 | CAGAGGCCAGUG | 3451 | AD-26734, AD-18930, AD-18963, AD-26733, AD-26735, AD-19078 |
| 1775 | ACUGGCCUCUGA | 2057 | UCAGAGGCCAGU | 3452 | AD-26734, AD-18930, AD-18963, AD-26733, AD-18948, AD-19078 |
| 1776 | CUGGCCUCUGAU | 2058 | AUCAGAGGCCAG | 3453 | AD-26734, AD-18963, AD-26733, AD-26735, AD-18948, AD-19078 |
| 1777 | UGGCCUCUGAUA | 2059 | UAUCAGAGGCCA | 3454 | AD-26734, AD-18930, AD-26736, AD-18963, AD-26735, AD-18948, AD-19078 |
| 1778 | GGCCUCUGAUAA | 2060 | UUAUCAGAGGCC | 3455 | AD-18930, AD-26736, AD-18963, AD-26735, AD-18948, AD-19078 |
| 1779 | GCCUCUGAUAAA | 2061 | UUUAUCAGAGGC | 3456 | AD-18930, AD-26736, AD-18963, AD-18948, AD-19078 |
| 1780 | CCUCUGAUAAAG | 2062 | CUUUAUCAGAGG | 3457 | AD-18930, AD-26736, AD-18948, AD-19078 |
| 1781 | CUCUGAUAAAGG | 2063 | CCUUUAUCAGAG | 3458 | AD-26736, AD-18948, AD-19078 |
| 1782 | UCUGAUAAAGGC | 2064 | GCCUUUAUCAGA | 3459 | AD-26736, AD-18948, AD-26737 |
| 1783 | CUGAUAAAGGCU | 2065 | AGCCUUUAUCAG | 3460 | AD-26736, AD-26737 |
| 1784 | UGAUAAAGGCUA | 2066 | UAGCCUUUAUCA | 3461 | AD-26736, AD-26737 |
| 1786 | AUAAAGGCUACU | 2067 | AGUAGCCUUUAU | 3462 | AD-26738, AD-26737 |
| 1787 | UAAAGGCUACUG | 2068 | CAGUAGCCUUUA | 3463 | AD-26738, AD-26737 |
| 1788 | AAAGGCUACUGU | 2069 | ACAGUAGCCUUU | 3464 | AD-26738, AD-26737 |
| 1789 | AAGGCUACUGUU | 2070 | AACAGUAGCCUU | 3465 | AD-26738, AD-26737 |
| 1791 | GGCUACUGUUGG | 2071 | CCAACAGUAGCC | 3466 | AD-26738, AD-26739 |
| 1792 | GCUACUGUUGGA | 2072 | UCCAACAGUAGC | 3467 | AD-26738, AD-26739 |
| 1793 | CUACUGUUGGAU | 2073 | AUCCAACAGUAG | 3468 | AD-26738, AD-26739 |
| 1795 | ACUGUUGGAUUG | 2074 | CAAUCCAACAGU | 3469 | AD-18983, AD-26739 |
| 1796 | CUGUUGGAUUGA | 2075 | UCAAUCCAACAG | 3470 | AD-18983, AD-26739, AD-18897 |
| 1797 | UGUUGGAUUGAU | 2076 | AUCAAUCCAACA | 3471 | AD-26740, AD-18983, AD-26739, AD-18897 |
| 1798 | GUUGGAUUGAUU | 2077 | AAUCAAUCCAAC | 3472 | AD-26740, AD-26739, AD-18897 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1799 | UUGGAUUGAUUC | 2078 | GAAUCAAUCCAA | 3473 | AD-26740, AD-18983, AD-18897 |
| 1800 | UGGAUUGAUUCG | 2079 | CGAAUCAAUCCA | 3474 | AD-26740, AD-18897, AD-26921 |
| 1801 | GGAUUGAUUCGA | 2080 | UCGAAUCAAUCC | 3475 | AD-26740, AD-18983, AD-18897, AD-26921 |
| 1802 | GAUUGAUUCGAA | 2081 | UUCGAAUCAAUC | 3476 | AD-18983, AD-18897, AD-26921 |
| 1803 | AUUGAUUCGAAA | 2082 | UUUCGAAUCAAU | 3477 | AD-26740, AD-18897, AD-26921 |
| 1804 | UUGAUUCGAAAU | 2083 | AUUUCGAAUCAA | 3478 | AD-26740, AD-26921 |
| 1848 | GCGUGAGCAGGG | 2084 | CCCUGCUCACGC | 3479 | AD-26175, AD-26176 |
| 1849 | CGUGAGCAGGGU | 2085 | ACCCUGCUCACG | 3480 | AD-26175, AD-26176 |
| 1850 | GUGAGCAGGGUG | 2086 | CACCCUGCUCAC | 3481 | AD-26175, AD-26176 |
| 1851 | UGAGCAGGGUGC | 2087 | GCACCCUGCUCA | 3482 | AD-26175, AD-26176 |
| 1852 | GAGCAGGGUGCC | 2088 | GGCACCCUGCUC | 3483 | AD-26175, AD-26176 |
| 1853 | AGCAGGGUGCCA | 2089 | UGGCACCCUGCU | 3484 | AD-26175, AD-26176 |
| 1854 | GCAGGGUGCCAU | 2090 | AUGGCACCCUGC | 3485 | AD-26175, AD-26176 |
| 1859 | GUGCCAUUCCAC | 2091 | GUGGAAUGGCAC | 3486 | AD-19742, AD-19749 |
| 1860 | UGCCAUUCCACG | 2092 | CGUGGAAUGGCA | 3487 | AD-26741, AD-19749 |
| 1861 | GCCAUUCCACGA | 2093 | UCGUGGAAUGGC | 3488 | AD-26741, AD-19742 |
| 1862 | CCAUUCCACGAC | 2094 | GUCGUGGAAUGG | 3489 | AD-26741, AD-19742, AD-19749 |
| 1863 | CAUUCCACGACU | 2095 | AGUCGUGGAAUG | 3490 | AD-26741, AD-19742, AD-19749, AD-19762 |
| 1864 | AUUCCACGACUA | 2096 | UAGUCGUGGAAU | 3491 | AD-26741, AD-19742, AD-19749 |
| 1865 | UUCCACGACUAG | 2097 | CUAGUCGUGGAA | 3492 | AD-26742, AD-26741, AD-19742, AD-19749, AD-19762 |
| 1866 | UCCACGACUAGU | 2098 | ACUAGUCGUGGA | 3493 | AD-26742, AD-26741, AD-19749, AD-19762 |
| 1867 | CCACGACUAGUU | 2099 | AACUAGUCGUGG | 3494 | AD-26742, AD-26741, AD-19751, AD-19762 |
| 1868 | CACGACUAGUUC | 2100 | GAACUAGUCGUG | 3495 | AD-26742, AD-19751, AD-19762, AD-19752 |
| 1869 | ACGACUAGUUCA | 2101 | UGAACUAGUCGU | 3496 | AD-26742, AD-26743, AD-19751, AD-19762 |
| 1870 | CGACUAGUUCAG | 2102 | CUGAACUAGUCG | 3497 | AD-26742, AD-26743, AD-19751, AD-19762, AD-19752 |
| 1871 | GACUAGUUCAGU | 2103 | ACUGAACUAGUC | 3498 | AD-26742, AD-26743, AD-19751, AD-19752 |
| 1872 | ACUAGUUCAGUU | 2104 | AACUGAACUAGU | 3499 | AD-26742, AD-26743, AD-19751, AD-19752, AD-26744 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1873 | CUAGUUCAGUUG | 2105 | CAACUGAACUAG | 3500 | AD-26743, AD-19752, AD-26744 |
| 1874 | UAGUUCAGUUGC | 2106 | GCAACUGAACUA | 3501 | AD-26743, AD-19751, AD-19752, AD-26744 |
| 1875 | AGUUCAGUUGCU | 2107 | AGCAACUGAACU | 3502 | AD-26743, AD-19753, AD-26744 |
| 1876 | GUUCAGUUGCUU | 2108 | AAGCAACUGAAC | 3503 | AD-26743, AD-19753, AD-26744 |
| 1877 | UUCAGUUGCUUG | 2109 | CAAGCAACUGAA | 3504 | AD-19753, AD-26744 |
| 1878 | UCAGUUGCUUGU | 2110 | ACAAGCAACUGA | 3505 | AD-19753, AD-26744 |
| 1879 | CAGUUGCUUGUU | 2111 | AACAAGCAACUG | 3506 | AD-19753, AD-26744 |
| 1881 | GUUGCUUGUUCG | 2112 | CGAACAAGCAAC | 3507 | AD-19753, AD-26745 |
| 1882 | UUGCUUGUUCGU | 2113 | ACGAACAAGCAA | 3508 | AD-19753, AD-26745 |
| 1887 | UGUUCGUGCACA | 2114 | UGUGCACGAACA | 3509 | AD-26746, AD-26745 |
| 1888 | GUUCGUGCACAU | 2115 | AUGUGCACGAAC | 3510 | AD-26746, AD-26747, AD-26745 |
| 1889 | UUCGUGCACAUC | 2116 | GAUGUGCACGAA | 3511 | AD-26746, AD-26747 |
| 1890 | UCGUGCACAUCA | 2117 | UGAUGUGCACGA | 3512 | AD-26746, AD-26747 |
| 1891 | CGUGCACAUCAG | 2118 | CUGAUGUGCACG | 3513 | AD-26746, AD-26747 |
| 1892 | GUGCACAUCAGG | 2119 | CCUGAUGUGCAC | 3514 | AD-26746, AD-26747 |
| 1893 | UGCACAUCAGGA | 2120 | UCCUGAUGUGCA | 3515 | AD-26746, AD-26747 |
| 1894 | GCACAUCAGGAU | 2121 | AUCCUGAUGUGC | 3516 | AD-26746, AD-26747 |
| 1907 | CCCAGCGCCGUA | 2122 | UACGGCGCUGGG | 3517 | AD-19738, AD-19754 |
| 1908 | CCAGCGCCGUAC | 2123 | GUACGGCGCUGG | 3518 | AD-19738, AD-19754 |
| 1909 | CAGCGCCGUACG | 2124 | CGUACGGCGCUG | 3519 | AD-19738, AD-19754 |
| 1910 | AGCGCCGUACGU | 2125 | ACGUACGGCGCU | 3520 | AD-19738, AD-19754 |
| 1911 | GCGCCGUACGUC | 2126 | GACGUACGGCGC | 3521 | AD-19738, AD-19754 |
| 1912 | CGCCGUACGUCC | 2127 | GGACGUACGGCG | 3522 | AD-19738, AD-19754 |
| 1927 | GGUGGGACACAG | 2128 | CUGUGUCCCACC | 3523 | AD-26184, AD-26748 |
| 1928 | GUGGGACACAGC | 2129 | GCUGUGUCCCAC | 3524 | AD-26749, AD-26184, AD-26748 |
| 1929 | UGGGACACAGCA | 2130 | UGCUGUGUCCCA | 3525 | AD-26749, AD-26750, AD-26184, AD-26748 |
| 1930 | GGGACACAGCAG | 2131 | CUGCUGUGUCCC | 3526 | AD-26749, AD-26750, AD-26184 |
| 1931 | GGACACAGCAGC | 2132 | GCUGCUGUGUCC | 3527 | AD-26749, AD-26184, AD-26748 |
| 1932 | GACACAGCAGCA | 2133 | UGCUGCUGUGUC | 3528 | AD-26749, AD-26750, AD-26184, AD-26748 |
| 1933 | ACACAGCAGCAA | 2134 | UUGCUGCUGUGU | 3529 | AD-26750, AD-26184, AD-26748 |
| 1934 | CACAGCAGCAAU | 2135 | AUUGCUGCUGUG | 3530 | AD-26749, AD-26750, AD-26748 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 1935 | ACAGCAGCAAUU | 2136 | AAUUGCUGCUGU | 3531 | AD-26749, AD-26750 |
| 1955 | GGGUCCGCAUGG | 2137 | CCAUGCGGACCC | 3532 | AD-26751, AD-26752 |
| 1956 | GGUCCGCAUGGA | 2138 | UCCAUGCGGACC | 3533 | AD-26751, AD-26752 |
| 1957 | GUCCGCAUGGAA | 2139 | UUCCAUGCGGAC | 3534 | AD-26751, AD-26752 |
| 1958 | UCCGCAUGGAAG | 2140 | CUUCCAUGCGGA | 3535 | AD-26751, AD-26752 |
| 1959 | CCGCAUGGAAGA | 2141 | UCUUCCAUGCGG | 3536 | AD-26751, AD-26752 |
| 1960 | CGCAUGGAAGAA | 2142 | UUCUUCCAUGCG | 3537 | AD-26751, AD-26752 |
| 1961 | GCAUGGAAGAAA | 2143 | UUUCUUCCAUGC | 3538 | AD-26751, AD-26752 |
| 2001 | CAUCCUAGCUCG | 2144 | CGAGCUAGGAUG | 3539 | AD-26753, AD-26754 |
| 2002 | AUCCUAGCUCGG | 2145 | CCGAGCUAGGAU | 3540 | AD-26753, AD-26754 |
| 2003 | UCCUAGCUCGGG | 2146 | CCCGAGCUAGGA | 3541 | AD-26753, AD-26754 |
| 2004 | CCUAGCUCGGGA | 2147 | UCCCGAGCUAGG | 3542 | AD-26753, AD-26754 |
| 2005 | CUAGCUCGGGAU | 2148 | AUCCCGAGCUAG | 3543 | AD-26753, AD-26754 |
| 2006 | UAGCUCGGGAUG | 2149 | CAUCCCGAGCUA | 3544 | AD-26755, AD-26754 |
| 2007 | AGCUCGGGAUGU | 2150 | ACAUCCCGAGCU | 3545 | AD-26755, AD-26754 |
| 2008 | GCUCGGGAUGUU | 2151 | AACAUCCCGAGC | 3546 | AD-26755, AD-26754 |
| 2011 | CGGGAUGUUCAC | 2152 | GUGAACAUCCCG | 3547 | AD-26755, AD-20124 |
| 2012 | GGGAUGUUCACA | 2153 | UGUGAACAUCCC | 3548 | AD-26756, AD-26755, AD-20124 |
| 2013 | GGAUGUUCACAA | 2154 | UUGUGAACAUCC | 3549 | AD-26756, AD-26755, AD-26757, AD-20124 |
| 2014 | GAUGUUCACAAC | 2155 | GUUGUGAACAUC | 3550 | AD-26756, AD-26757, AD-20124 |
| 2015 | AUGUUCACAACC | 2156 | GGUUGUGAACAU | 3551 | AD-26756, AD-26757, AD-20124 |
| 2016 | UGUUCACAACCG | 2157 | CGGUUGUGAACA | 3552 | AD-26756, AD-19750, AD-20124 |
| 2017 | GUUCACAACCGA | 2158 | UCGGUUGUGAAC | 3553 | AD-19750, AD-26757, AD-20124 |
| 2018 | UUCACAACCGAA | 2159 | UUCGGUUGUGAA | 3554 | AD-26756, AD-19750, AD-26757, AD-20124 |
| 2019 | UCACAACCGAAU | 2160 | AUUCGGUUGUGA | 3555 | AD-26756, AD-19750, AD-26757 |
| 2020 | CACAACCGAAUU | 2161 | AAUUCGGUUGUG | 3556 | AD-19750, AD-26757 |
| 2041 | GGACUAAAUACC | 2162 | GGUAUUUAGUCC | 3557 | AD-26758, AD-26759 |
| 2042 | GACUAAAUACCA | 2163 | UGGUAUUUAGUC | 3558 | AD-26758, AD-26759 |
| 2043 | ACUAAAUACCAU | 2164 | AUGGUAUUUAGU | 3559 | AD-26758, AD-26759 |
| 2044 | CUAAAUACCAUU | 2165 | AAUGGUAUUUAG | 3560 | AD-26758, AD-26759 |
| 2045 | UAAAUACCAUUC | 2166 | GAAUGGUAUUUA | 3561 | AD-26760, AD-26759 |
| 2046 | AAAUACCAUUCC | 2167 | GGAAUGGUAUUU | 3562 | AD-26760, AD-26761, AD-26759 |

TABLE 4-continued

Groups of overlapping RNAi agents to Beta-Catenin

| Position | Sense overlap | SEQ ID NO: Anti-sense overlap | SEQ ID NO: | Overlapping groups of RNAi agents |
|---|---|---|---|---|
| 2047 | AAUACCAUUCCA | 2168 UGGAAUGGUAUU | 3563 | AD-26760, AD-26759 |
| 2048 | AUACCAUUCCAU | 2169 AUGGAAUGGUAU | 3564 | AD-26760, AD-26761, AD-26759, AD-18982 |
| 2049 | UACCAUUCCAUU | 2170 AAUGGAAUGGUA | 3565 | AD-26760, AD-19062, AD-18982 |
| 2050 | ACCAUUCCAUUG | 2171 CAAUGGAAUGGU | 3566 | AD-26760, AD-26761, AD-19062, AD-18982 |
| 2051 | CCAUUCCAUUGU | 2172 ACAAUGGAAUGG | 3567 | AD-26761, AD-19062, AD-18982 |
| 2052 | CAUUCCAUUGUU | 2173 AACAAUGGAAUG | 3568 | AD-26760, AD-26761, AD-19062 |
| 2053 | AUUCCAUUGUUU | 2174 AAACAAUGGAAU | 3569 | AD-26761, AD-19062, AD-18982 |
| 2054 | UUCCAUUGUUUG | 2175 CAAACAAUGGAA | 3570 | AD-19062, AD-18982 |
| 2055 | UCCAUUGUUUGU | 2176 ACAAACAAUGGA | 3571 | AD-19062, AD-18982 |
| 2059 | UUGUUUGUGCAG | 2177 CUGCACAAACAA | 3572 | AD-26763, AD-26762 |
| 2060 | UGUUUGUGCAGC | 2178 GCUGCACAAACA | 3573 | AD-26764, AD-26763, AD-26762 |
| 2061 | GUUUGUGCAGCU | 2179 AGCUGCACAAAC | 3574 | AD-26764, AD-26765, AD-26763, AD-26762 |
| 2062 | UUUGUGCAGCUG | 2180 CAGCUGCACAAA | 3575 | AD-26764, AD-26765, AD-26766, AD-26763, AD-26762 |
| 2063 | UUGUGCAGCUGC | 2181 GCAGCUGCACAA | 3576 | AD-26764, AD-26765, AD-26766, AD-26763 |
| 2064 | UGUGCAGCUGCU | 2182 AGCAGCUGCACA | 3577 | AD-26764, AD-26766, AD-26763, AD-26762 |
| 2065 | GUGCAGCUGCUU | 2183 AAGCAGCUGCAC | 3578 | AD-26765, AD-26766, AD-26763, AD-26762 |
| 2066 | UGCAGCUGCUUU | 2184 AAAGCAGCUGCA | 3579 | AD-26764, AD-26765, AD-26766, AD-26763 |
| 2067 | GCAGCUGCUUUA | 2185 UAAAGCAGCUGC | 3580 | AD-26764, AD-26765, AD-26766 |
| 2068 | CAGCUGCUUUAU | 2186 AUAAAGCAGCUG | 3581 | AD-26765, AD-26766 |
| 2069 | AGCUGCUUUAUU | 2187 AAUAAAGCAGCU | 3582 | AD-26766, AD-26767 |
| 2070 | GCUGCUUUAUUC | 2188 GAAUAAAGCAGC | 3583 | AD-26768, AD-26767 |
| 2071 | CUGCUUUAUUCU | 2189 AGAAUAAAGCAG | 3584 | AD-26768, AD-26767 |
| 2072 | UGCUUUAUUCUC | 2190 GAGAAUAAAGCA | 3585 | AD-26768, AD-26767 |
| 2073 | GCUUUAUUCUCC | 2191 GGAGAAUAAAGC | 3586 | AD-26768, AD-18928 |
| 2074 | CUUUAUUCUCCC | 2192 GGGAGAAUAAAG | 3587 | AD-26768, AD-18928, AD-26767 |
| 2075 | UUUAUUCUCCCA | 2193 UGGGAGAAUAAA | 3588 | AD-26769, AD-18928, AD-26767 |
| 2076 | UUAUUCUCCCAU | 2194 AUGGGAGAAUAA | 3589 | AD-26769, AD-26768, AD-18928, AD-26767 |
| 2077 | UAUUCUCCCAUU | 2195 AAUGGGAGAAUA | 3590 | AD-26769, AD-26768, AD-18928 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2078 | AUUCUCCCAUUG | 2196 | CAAUGGGAGAAU | 3591 | AD-26770, AD-18928 |
| 2079 | UUCUCCCAUUGA | 2197 | UCAAUGGGAGAA | 3592 | AD-26769, AD-26770 |
| 2080 | UCUCCCAUUGAA | 2198 | UUCAAUGGGAGA | 3593 | AD-26769, AD-26770 |
| 2081 | CUCCCAUUGAAA | 2199 | UUUCAAUGGGAG | 3594 | AD-26769, AD-26770 |
| 2082 | UCCCAUUGAAAA | 2200 | UUUUCAAUGGGA | 3595 | AD-26771, AD-26769, AD-26770 |
| 2083 | CCCAUUGAAAAC | 2201 | GUUUUCAAUGGG | 3596 | AD-26771, AD-26770 |
| 2084 | CCAUUGAAAACA | 2202 | UGUUUUCAAUGG | 3597 | AD-26771, AD-26770 |
| 2085 | CAUUGAAAACAU | 2203 | AUGUUUUCAAUG | 3598 | AD-26771, AD-26770 |
| 2100 | AAGAGUAGCUGC | 2204 | GCAGCUACUCUU | 3599 | AD-18962, AD-18895 |
| 2101 | AGAGUAGCUGCA | 2205 | UGCAGCUACUCU | 3600 | AD-18962, AD-18895 |
| 2102 | GAGUAGCUGCAG | 2206 | CUGCAGCUACUC | 3601 | AD-18962, AD-18895 |
| 2104 | GUAGCUGCAGGG | 2207 | CCCUGCAGCUAC | 3602 | AD-18962, AD-18976 |
| 2105 | UAGCUGCAGGGG | 2208 | CCCCUGCAGCUA | 3603 | AD-19003, AD-18962 |
| 2106 | AGCUGCAGGGGU | 2209 | ACCCCUGCAGCU | 3604 | AD-19003, AD-18962, AD-18976 |
| 2107 | GCUGCAGGGGUC | 2210 | GACCCCUGCAGC | 3605 | AD-18962, AD-18976 |
| 2108 | CUGCAGGGGUCC | 2211 | GGACCCCUGCAG | 3606 | AD-19003, AD-18976 |
| 2109 | UGCAGGGGUCCU | 2212 | AGGACCCCUGCA | 3607 | AD-19003, AD-26772, AD-18976 |
| 2110 | GCAGGGGUCCUC | 2213 | GAGGACCCCUGC | 3608 | AD-19003, AD-26772, AD-18976 |
| 2111 | CAGGGGUCCUCU | 2214 | AGAGGACCCCUG | 3609 | AD-18923, AD-19003, AD-26772, AD-18976 |
| 2112 | AGGGGUCCUCUG | 2215 | CAGAGGACCCCU | 3610 | AD-18923, AD-19003, AD-18955, AD-26772 |
| 2113 | GGGGUCCUCUGU | 2216 | ACAGAGGACCCC | 3611 | AD-18923, AD-18955, AD-26772 |
| 2114 | GGGUCCUCUGUG | 2217 | CACAGAGGACCC | 3612 | AD-18923, AD-18934, AD-18955, AD-26772 |
| 2115 | GGUCCUCUGUGA | 2218 | UCACAGAGGACC | 3613 | AD-18923, AD-18934, AD-19052, AD-18912, AD-18955 |
| 2116 | GUCCUCUGUGAA | 2219 | UUCACAGAGGAC | 3614 | AD-18923, AD-19052, AD-18912, AD-18955, AD-26772 |
| 2117 | UCCUCUGUGAAC | 2220 | GUUCACAGAGGA | 3615 | AD-18923, AD-18934, AD-19052, AD-18912, AD-18955 |
| 2118 | CCUCUGUGAACU | 2221 | AGUUCACAGAGG | 3616 | AD-18923, AD-18934, AD-18973, AD-19052, AD-18912, AD-18955 |
| 2119 | CUCUGUGAACUU | 2222 | AAGUUCACAGAG | 3617 | AD-18934, AD-18973, AD-19052, AD-18912, AD-18955 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2120 | UCUGUGAACUUG | 2223 | CAAGUUCACAGA | 3618 | AD-18934, AD-18973, AD-19052, AD-18912 |
| 2121 | CUGUGAACUUGC | 2224 | GCAAGUUCACAG | 3619 | AD-18973, AD-19052, AD-18912 |
| 2122 | UGUGAACUUGCU | 2225 | AGCAAGUUCACA | 3620 | AD-18973, AD-19047 |
| 2123 | GUGAACUUGCUC | 2226 | GAGCAAGUUCAC | 3621 | AD-18973, AD-19047, AD-18971 |
| 2124 | UGAACUUGCUCA | 2227 | UGAGCAAGUUCA | 3622 | AD-18973, AD-19047, AD-18971, AD-18961 |
| 2125 | GAACUUGCUCAG | 2228 | CUGAGCAAGUUC | 3623 | AD-18973, AD-19047, AD-18971, AD-18961 |
| 2126 | AACUUGCUCAGG | 2229 | CCUGAGCAAGUU | 3624 | AD-19047, AD-18984, AD-18971, AD-18961 |
| 2127 | ACUUGCUCAGGA | 2230 | UCCUGAGCAAGU | 3625 | AD-19047, AD-18984, AD-26773, AD-18971, AD-18961 |
| 2128 | CUUGCUCAGGAC | 2231 | GUCCUGAGCAAG | 3626 | AD-19047, AD-18984, AD-26773, AD-18971 |
| 2129 | UUGCUCAGGACA | 2232 | UGUCCUGAGCAA | 3627 | AD-19047, AD-18984, AD-26773, AD-18971, AD-18961 |
| 2130 | UGCUCAGGACAA | 2233 | UUGUCCUGAGCA | 3628 | AD-18984, AD-26773, AD-18971, AD-18961 |
| 2131 | GCUCAGGACAAG | 2234 | CUUGUCCUGAGC | 3629 | AD-18984, AD-26773, AD-18961 |
| 2132 | CUCAGGACAAGG | 2235 | CCUUGUCCUGAG | 3630 | AD-18984, AD-26773 |
| 2133 | UCAGGACAAGGA | 2236 | UCCUUGUCCUGA | 3631 | AD-18984, AD-26773 |
| 2178 | AGCUCCUCUGAC | 2237 | GUCAGAGGAGCU | 3632 | AD-26775, AD-26774 |
| 2179 | GCUCCUCUGACA | 2238 | UGUCAGAGGAGC | 3633 | AD-26775, AD-26774 |
| 2180 | CUCCUCUGACAG | 2239 | CUGUCAGAGGAG | 3634 | AD-26775, AD-26774 |
| 2181 | UCCUCUGACAGA | 2240 | UCUGUCAGAGGA | 3635 | AD-26775, AD-26774 |
| 2182 | CCUCUGACAGAG | 2241 | CUCUGUCAGAGG | 3636 | AD-26775, AD-26776 |
| 2183 | CUCUGACAGAGU | 2242 | ACUCUGUCAGAG | 3637 | AD-26776, AD-26774 |
| 2184 | UCUGACAGAGUU | 2243 | AACUCUGUCAGA | 3638 | AD-26775, AD-26776, AD-26774 |
| 2185 | CUGACAGAGUUA | 2244 | UAACUCUGUCAG | 3639 | AD-26775, AD-26776 |
| 2188 | ACAGAGUUACUU | 2245 | AAGUAACUCUGU | 3640 | AD-26777, AD-26776 |
| 2191 | GAGUUACUUCAC | 2246 | GUGAAGUAACUC | 3641 | AD-26777, AD-19755 |
| 2192 | AGUUACUUCACU | 2247 | AGUGAAGUAACU | 3642 | AD-26777, AD-26778, AD-19755 |
| 2193 | GUUACUUCACUC | 2248 | GAGUGAAGUAAC | 3643 | AD-26777, AD-26779, AD-26778, AD-19755 |
| 2194 | UUACUUCACUCU | 2249 | AGAGUGAAGUAA | 3644 | AD-26777, AD-26779, AD-19755 |
| 2195 | UACUUCACUCUA | 2250 | UAGAGUGAAGUA | 3645 | AD-26777, AD-26778, AD-19755 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2196 | ACUUCACUCUAG | 2251 | CUAGAGUGAAGU | 3646 | AD-26780, AD-26778, AD-19755 |
| 2197 | CUUCACUCUAGG | 2252 | CCUAGAGUGAAG | 3647 | AD-26779, AD-26780, AD-26778, AD-19755 |
| 2198 | UUCACUCUAGGA | 2253 | UCCUAGAGUGAA | 3648 | AD-26779, AD-26780, AD-26778, AD-19755 |
| 2199 | UCACUCUAGGAA | 2254 | UUCCUAGAGUGA | 3649 | AD-26779, AD-26780, AD-26778 |
| 2200 | CACUCUAGGAAU | 2255 | AUUCCUAGAGUG | 3650 | AD-26779, AD-26780 |
| 2234 | CUGCUGUUUUGU | 2256 | ACAAAACAGCAG | 3651 | AD-26782, AD-26781 |
| 2235 | UGCUGUUUUGUU | 2257 | AACAAAACAGCA | 3652 | AD-26782, AD-26781 |
| 2236 | GCUGUUUUGUUC | 2258 | GAACAAAACAGC | 3653 | AD-26782, AD-26781 |
| 2237 | CUGUUUUGUUCC | 2259 | GGAACAAAACAG | 3654 | AD-26782, AD-26781 |
| 2238 | UGUUUUGUUCCG | 2260 | CGGAACAAAACA | 3655 | AD-26782, AD-26781 |
| 2239 | GUUUUGUUCCGA | 2261 | UCGGAACAAAAC | 3656 | AD-26782, AD-26781 |
| 2240 | UUUUGUUCCGAA | 2262 | UUCGGAACAAAA | 3657 | AD-26782, AD-26781 |
| 2256 | UGAGGACAAGCC | 2263 | GGCUUGUCCUCA | 3658 | AD-26783, AD-26784 |
| 2257 | GAGGACAAGCCA | 2264 | UGGCUUGUCCUC | 3659 | AD-26783, AD-26784 |
| 2258 | AGGACAAGCCAC | 2265 | GUGGCUUGUCCU | 3660 | AD-26783, AD-26784 |
| 2259 | GGACAAGCCACA | 2266 | UGUGGCUUGUCC | 3661 | AD-26783, AD-26784 |
| 2260 | GACAAGCCACAA | 2267 | UUGUGGCUUGUC | 3662 | AD-26783, AD-26784 |
| 2261 | ACAAGCCACAAG | 2268 | CUUGUGGCUUGU | 3663 | AD-26784, AD-26785 |
| 2262 | CAAGCCACAAGA | 2269 | UCUUGUGGCUUG | 3664 | AD-26784, AD-26785 |
| 2263 | AAGCCACAAGAU | 2270 | AUCUUGUGGCUU | 3665 | AD-26784, AD-26785 |
| 2264 | AGCCACAAGAUU | 2271 | AAUCUUGUGGCU | 3666 | AD-26786, AD-26785 |
| 2265 | GCCACAAGAUUA | 2272 | UAAUCUUGUGGC | 3667 | AD-26786, AD-26785 |
| 2266 | CCACAAGAUUAC | 2273 | GUAAUCUUGUGG | 3668 | AD-26786, AD-26785 |
| 2267 | CACAAGAUUACA | 2274 | UGUAAUCUUGUG | 3669 | AD-26786, AD-26785 |
| 2268 | ACAAGAUUACAA | 2275 | UUGUAAUCUUGU | 3670 | AD-26786, AD-26785 |
| 2271 | AGAUUACAAGAA | 2276 | UUCUUGUAAUCU | 3671 | AD-26786, AD-26787 |
| 2277 | CAAGAAACGGCU | 2277 | AGCCGUUUCUUG | 3672 | AD-26788, AD-26787 |
| 2278 | AAGAAACGGCUU | 2278 | AAGCCGUUUCUU | 3673 | AD-26788, AD-26787 |
| 2302 | ACCAGCUCUCUC | 2279 | GAGAGAGCUGGU | 3674 | AD-26790, AD-26789 |
| 2303 | CCAGCUCUCUCU | 2280 | AGAGAGAGCUGG | 3675 | AD-26790, AD-26789 |
| 2304 | CAGCUCUCUCUU | 2281 | AAGAGAGAGCUG | 3676 | AD-26790, AD-26789 |
| 2325 | GCCAAUGGCUUG | 2282 | CAAGCCAUUGGC | 3677 | AD-18909, AD-18910 |
| 2326 | CCAAUGGCUUGG | 2283 | CCAAGCCAUUGG | 3678 | AD-18909, AD-18910, AD-19080 |
| 2327 | CAAUGGCUUGGA | 2284 | UCCAAGCCAUUG | 3679 | AD-18909, AD-18947, AD-18910, AD-19080 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2328 | AAUGGCUUGGAA | 2285 | UUCCAAGCCAUU | 3680 | AD-18909, AD-19051, AD-18947, AD-18910, AD-19080 |
| 2329 | AUGGCUUGGAAU | 2286 | AUUCCAAGCCAU | 3681 | AD-18909, AD-19051, AD-18947, AD-18978, AD-18910 |
| 2330 | UGGCUUGGAAUG | 2287 | CAUUCCAAGCCA | 3682 | AD-18909, AD-19051, AD-18947, AD-18978, AD-19080 |
| 2331 | GGCUUGGAAUGA | 2288 | UCAUUCCAAGCC | 3683 | AD-18909, AD-19051, AD-18947, AD-18978, AD-18910, AD-19080 |
| 2332 | GCUUGGAAUGAG | 2289 | CUCAUUCCAAGC | 3684 | AD-19051, AD-18947, AD-18978, AD-18910, AD-19080 |
| 2333 | CUUGGAAUGAGA | 2290 | UCUCAUUCCAAG | 3685 | AD-19051, AD-18947, AD-18978, AD-19080 |
| 2334 | UUGGAAUGAGAC | 2291 | GUCUCAUUCCAA | 3686 | AD-19051, AD-18947, AD-18978 |
| 2335 | UGGAAUGAGACU | 2292 | AGUCUCAUUCCA | 3687 | AD-19051, AD-18978 |
| 2370 | UGCCCAGGGAGA | 2293 | UCUCCCUGGGCA | 3688 | AD-26677, AD-26791 |
| 2371 | GCCCAGGGAGAA | 2294 | UUCUCCCUGGGC | 3689 | AD-26677, AD-26791 |
| 2374 | CAGGGAGAACCC | 2295 | GGGUUCUCCCUG | 3690 | AD-26792, AD-26677 |
| 2375 | AGGGAGAACCCC | 2296 | GGGGUUCUCCCU | 3691 | AD-26793, AD-26677 |
| 2376 | GGGAGAACCCCU | 2297 | AGGGGUUCUCCC | 3692 | AD-26793, AD-26792 |
| 2377 | GGAGAACCCCUU | 2298 | AAGGGGUUCUCC | 3693 | AD-26793, AD-26792, AD-26677 |
| 2378 | GAGAACCCCUUG | 2299 | CAAGGGGUUCUC | 3694 | AD-26793, AD-26792 |
| 2379 | AGAACCCCUUGG | 2300 | CCAAGGGGUUCU | 3695 | AD-26793, AD-26792 |
| 2380 | GAACCCCUUGGA | 2301 | UCCAAGGGGUUC | 3696 | AD-26793, AD-26792 |
| 2381 | AACCCCUUGGAU | 2302 | AUCCAAGGGGUU | 3697 | AD-26793, AD-26792 |
| 2385 | CCUUGGAUAUCG | 2303 | CGAUAUCCAAGG | 3698 | AD-26794, AD-19063 |
| 2386 | CUUGGAUAUCGC | 2304 | GCGAUAUCCAAG | 3699 | AD-26794, AD-19063 |
| 2387 | UUGGAUAUCGCC | 2305 | GGCGAUAUCCAA | 3700 | AD-18979, AD-26794, AD-19063 |
| 2388 | UGGAUAUCGCCA | 2306 | UGGCGAUAUCCA | 3701 | AD-18979, AD-19001, AD-26794, AD-19063 |
| 2389 | GGAUAUCGCCAG | 2307 | CUGGCGAUAUCC | 3702 | AD-18979, AD-18941, AD-19001, AD-26794, AD-19063 |
| 2390 | GAUAUCGCCAGG | 2308 | CCUGGCGAUAUC | 3703 | AD-18979, AD-18941, AD-19001, AD-18900, AD-26794, AD-19063 |
| 2391 | AUAUCGCCAGGA | 2309 | UCCUGGCGAUAU | 3704 | AD-18979, AD-18941, AD-19001, AD-18900, AD-26794 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2392 | UAUCGCCAGGAU | 2310 | AUCCUGGCGAUA | 3705 | AD-18979, AD-18941, AD-19001, AD-18900, AD-26794, AD-26795 |
| 2393 | AUCGCCAGGAUG | 2311 | CAUCCUGGCGAU | 3706 | AD-18979, AD-18941, AD-19001, AD-26795 |
| 2394 | UCGCCAGGAUGA | 2312 | UCAUCCUGGCGA | 3707 | AD-18979, AD-18941, AD-19001, AD-18900, AD-26795 |
| 2395 | CGCCAGGAUGAU | 2313 | AUCAUCCUGGCG | 3708 | AD-18941, AD-19001, AD-18900, AD-26795 |
| 2396 | GCCAGGAUGAUC | 2314 | GAUCAUCCUGGC | 3709 | AD-18941, AD-26796, AD-26795 |
| 2397 | CCAGGAUGAUCC | 2315 | GGAUCAUCCUGG | 3710 | AD-26796, AD-18900, AD-26795, AD-26797 |
| 2398 | CAGGAUGAUCCU | 2316 | AGGAUCAUCCUG | 3711 | AD-26796, AD-26795, AD-26797 |
| 2399 | AGGAUGAUCCUA | 2317 | UAGGAUCAUCCU | 3712 | AD-26796, AD-26795 |
| 2400 | GGAUGAUCCUAG | 2318 | CUAGGAUCAUCC | 3713 | AD-26796, AD-26797 |
| 2401 | GAUGAUCCUAGC | 2319 | GCUAGGAUCAUC | 3714 | AD-26796, AD-26798, AD-26797 |
| 2402 | AUGAUCCUAGCU | 2320 | AGCUAGGAUCAU | 3715 | AD-26796, AD-26797 |
| 2403 | UGAUCCUAGCUA | 2321 | UAGCUAGGAUCA | 3716 | AD-26796, AD-26798, AD-26797 |
| 2404 | GAUCCUAGCUAU | 2322 | AUAGCUAGGAUC | 3717 | AD-26798, AD-26797 |
| 2405 | AUCCUAGCUAUC | 2323 | GAUAGCUAGGAU | 3718 | AD-26799, AD-26798 |
| 2406 | UCCUAGCUAUCG | 2324 | CGAUAGCUAGGA | 3719 | AD-26799, AD-26800 |
| 2407 | CCUAGCUAUCGU | 2325 | ACGAUAGCUAGG | 3720 | AD-26799, AD-26798 |
| 2408 | CUAGCUAUCGUU | 2326 | AACGAUAGCUAG | 3721 | AD-26799, AD-26798, AD-26800 |
| 2409 | UAGCUAUCGUUC | 2327 | GAACGAUAGCUA | 3722 | AD-26799, AD-26800 |
| 2410 | AGCUAUCGUUCU | 2328 | AGAACGAUAGCU | 3723 | AD-26799, AD-26800 |
| 2411 | GCUAUCGUUCUU | 2329 | AAGAACGAUAGC | 3724 | AD-26799, AD-26800 |
| 2412 | CUAUCGUUCUUU | 2330 | AAAGAACGAUAG | 3725 | AD-26799, AD-26800 |
| 2419 | UCUUUUCACUCU | 2331 | AGAGUGAAAAGA | 3726 | AD-18951, AD-26801 |
| 2420 | CUUUUCACUCUG | 2332 | CAGAGUGAAAAG | 3727 | AD-18951, AD-26802, AD-26801 |
| 2421 | UUUUCACUCUGG | 2333 | CCAGAGUGAAAA | 3728 | AD-18951, AD-26803, AD-26802, AD-26801 |
| 2422 | UUUCACUCUGGU | 2334 | ACCAGAGUGAAA | 3729 | AD-18951, AD-26802, AD-26801 |
| 2423 | UUCACUCUGGUG | 2335 | CACCAGAGUGAA | 3730 | AD-18951, AD-26803, AD-26801 |
| 2424 | UCACUCUGGUGG | 2336 | CCACCAGAGUGA | 3731 | AD-26803, AD-26802 |
| 2425 | CACUCUGGUGGA | 2337 | UCCACCAGAGUG | 3732 | AD-26803, AD-26801 |

TABLE 4-continued

Groups of overlapping RNAi agents to Beta-Catenin

| Position | Sense overlap | SEQ ID NO: Anti-sense overlap | SEQ ID NO: | Overlapping groups of RNAi agents |
|---|---|---|---|---|
| 2426 | ACUCUGGUGGAU | 2338 AUCCACCAGAGU | 3733 | AD-26803, AD-26802, AD-26801 |
| 2427 | CUCUGGUGGAUA | 2339 UAUCCACCAGAG | 3734 | AD-26803, AD-26802 |
| 2435 | GAUAUGGCCAGG | 2340 CCUGGCCAUAUC | 3735 | AD-26805, AD-26804 |
| 2436 | AUAUGGCCAGGA | 2341 UCCUGGCCAUAU | 3736 | AD-26805, AD-26804 |
| 2437 | UAUGGCCAGGAU | 2342 AUCCUGGCCAUA | 3737 | AD-26805, AD-26804 |
| 2440 | GGCCAGGAUGCC | 2343 GGCAUCCUGGCC | 3738 | AD-26693, AD-26805 |
| 2441 | GCCAGGAUGCCU | 2344 AGGCAUCCUGGC | 3739 | AD-26693, AD-26805 |
| 2442 | CCAGGAUGCCUU | 2345 AAGGCAUCCUGG | 3740 | AD-26693, AD-26805 |
| 2453 | UGGGUAUGGACC | 2346 GGUCCAUACCCA | 3741 | AD-26806, AD-26807 |
| 2454 | GGGUAUGGACCC | 2347 GGGUCCAUACCC | 3742 | AD-26806, AD-26807 |
| 2455 | GGUAUGGACCCC | 2348 GGGGUCCAUACC | 3743 | AD-26806, AD-26807 |
| 2456 | GUAUGGACCCCA | 2349 UGGGGUCCAUAC | 3744 | AD-26806, AD-26807 |
| 2457 | UAUGGACCCCAU | 2350 AUGGGGUCCAUA | 3745 | AD-26806, AD-26811, AD-26807 |
| 2458 | AUGGACCCCAUG | 2351 CAUGGGGUCCAU | 3746 | AD-26811, AD-26807 |
| 2459 | UGGACCCCAUGA | 2352 UCAUGGGGUCCA | 3747 | AD-26811, AD-26807 |
| 2460 | GGACCCCAUGAU | 2353 AUCAUGGGGUCC | 3748 | AD-26811, AD-26807, AD-26812 |
| 2461 | GACCCCAUGAUG | 2354 CAUCAUGGGGUC | 3749 | AD-26811, AD-26812 |
| 2462 | ACCCCAUGAUGG | 2355 CCAUCAUGGGGU | 3750 | AD-26811, AD-26812 |
| 2463 | CCCCAUGAUGGA | 2356 UCCAUCAUGGGG | 3751 | AD-26811, AD-26812 |
| 2464 | CCCAUGAUGGAA | 2357 UUCCAUCAUGGG | 3752 | AD-26811, AD-26812 |
| 2465 | CCAUGAUGGAAC | 2358 GUUCCAUCAUGG | 3753 | AD-26813, AD-26812 |
| 2466 | CAUGAUGGAACA | 2359 UGUUCCAUCAUG | 3754 | AD-26813, AD-26812 |
| 2467 | AUGAUGGAACAU | 2360 AUGUUCCAUCAU | 3755 | AD-26813, AD-26812 |
| 2493 | CCACCCUGGUGC | 2361 GCACCAGGGUGG | 3756 | AD-26814, AD-26815 |
| 2494 | CACCCUGGUGCU | 2362 AGCACCAGGGUG | 3757 | AD-26814, AD-26815 |
| 2495 | ACCCUGGUGCUG | 2363 CAGCACCAGGGU | 3758 | AD-26814, AD-26815 |
| 2496 | CCCUGGUGCUGA | 2364 UCAGCACCAGGG | 3759 | AD-26814, AD-26815, AD-19057 |
| 2497 | CCUGGUGCUGAC | 2365 GUCAGCACCAGG | 3760 | AD-19071, AD-26814, AD-26815, AD-19057 |
| 2498 | CUGGUGCUGACU | 2366 AGUCAGCACCAG | 3761 | AD-19071, AD-26814, AD-26815, AD-18970, AD-19057 |
| 2499 | UGGUGCUGACUA | 2367 UAGUCAGCACCA | 3762 | AD-19071, AD-26814, AD-26815, AD-18970, AD-19057, AD-18892 |
| 2500 | GGUGCUGACUAU | 2368 AUAGUCAGCACC | 3763 | AD-19071, AD-26815, AD-18970, AD-19057, AD-18892 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2501 | GUGCUGACUAUC | 2369 | GAUAGUCAGCAC | 3764 | AD-19071, AD-18970, AD-19057, AD-18892 |
| 2502 | UGCUGACUAUCC | 2370 | GGAUAGUCAGCA | 3765 | AD-19071, AD-26816, AD-18970, AD-19057, AD-18892 |
| 2503 | GCUGACUAUCCA | 2371 | UGGAUAGUCAGC | 3766 | AD-19071, AD-19042, AD-26816, AD-18970, AD-19057 |
| 2504 | CUGACUAUCCAG | 2372 | CUGGAUAGUCAG | 3767 | AD-19071, AD-19042, AD-26816, AD-18970, AD-18919, AD-18892 |
| 2505 | UGACUAUCCAGU | 2373 | ACUGGAUAGUCA | 3768 | AD-19042, AD-18944, AD-18970, AD-18919, AD-18892 |
| 2506 | GACUAUCCAGUU | 2374 | AACUGGAUAGUC | 3769 | AD-19042, AD-26816, AD-18944, AD-18908, AD-18919, AD-18892 |
| 2507 | ACUAUCCAGUUG | 2375 | CAACUGGAUAGU | 3770 | AD-19042, AD-26816, AD-18967, AD-18944, AD-18908, AD-18919 |
| 2508 | CUAUCCAGUUGA | 2376 | UCAACUGGAUAG | 3771 | AD-19042, AD-26816, AD-18967, AD-18944, AD-18908, AD-19077, AD-18919 |
| 2509 | UAUCCAGUUGAU | 2377 | AUCAACUGGAUA | 3772 | AD-19042, AD-26816, AD-18967, AD-18944, AD-18908, AD-19077, AD-18919 |
| 2510 | AUCCAGUUGAUG | 2378 | CAUCAACUGGAU | 3773 | AD-19042, AD-18967, AD-18944, AD-18908, AD-19077, AD-18919 |
| 2511 | UCCAGUUGAUGG | 2379 | CCAUCAACUGGA | 3774 | AD-18967, AD-18944, AD-18908, AD-19077, AD-18919 |
| 2512 | CCAGUUGAUGGG | 2380 | CCCAUCAACUGG | 3775 | AD-18967, AD-18944, AD-18908, AD-19077 |
| 2513 | CAGUUGAUGGGC | 2381 | GCCCAUCAACUG | 3776 | AD-18967, AD-18908, AD-19077 |
| 2514 | AGUUGAUGGGCU | 2382 | AGCCCAUCAACU | 3777 | AD-26817, AD-18967, AD-19077 |
| 2515 | GUUGAUGGGCUG | 2383 | CAGCCCAUCAAC | 3778 | AD-26817, AD-19077 |
| 2544 | CCAGGACCUCAU | 2384 | AUGAGGUCCUGG | 3779 | AD-19073, AD-26818 |
| 2545 | CAGGACCUCAUG | 2385 | CAUGAGGUCCUG | 3780 | AD-19073, AD-26818 |
| 2546 | AGGACCUCAUGG | 2386 | CCAUGAGGUCCU | 3781 | AD-19073, AD-26818 |
| 2547 | GGACCUCAUGGA | 2387 | UCCAUGAGGUCC | 3782 | AD-19073, AD-26818 |
| 2548 | GACCUCAUGGAU | 2388 | AUCCAUGAGGUC | 3783 | AD-19073, AD-26818 |
| 2580 | CAAUCAGCUGGC | 2389 | GCCAGCUGAUUG | 3784 | AD-26819, AD-26820 |
| 2581 | AAUCAGCUGGCC | 2390 | GGCCAGCUGAUU | 3785 | AD-26819, AD-26820 |
| 2582 | AUCAGCUGGCCU | 2391 | AGGCCAGCUGAU | 3786 | AD-26819, AD-18989, AD-26820 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2583 | UCAGCUGGCCUG | 2392 | CAGGCCAGCUGA | 3787 | AD-18975, AD-26819, AD-18989, AD-26820 |
| 2584 | CAGCUGGCCUGG | 2393 | CCAGGCCAGCUG | 3788 | AD-18975, AD-26819, AD-18989, AD-26820 |
| 2585 | AGCUGGCCUGGU | 2394 | ACCAGGCCAGCU | 3789 | AD-18975, AD-19060, AD-26819, AD-18989, AD-26820 |
| 2586 | GCUGGCCUGGUU | 2395 | AACCAGGCCAGC | 3790 | AD-18975, AD-18898, AD-26819, AD-18989, AD-26820 |
| 2587 | CUGGCCUGGUUU | 2396 | AAACCAGGCCAG | 3791 | AD-18975, AD-19060, AD-18898, AD-18989, AD-26820 |
| 2588 | UGGCCUGGUUUG | 2397 | CAAACCAGGCCA | 3792 | AD-18975, AD-19059, AD-19060, AD-18964, AD-18898, AD-18989 |
| 2589 | GGCCUGGUUUGA | 2398 | UCAAACCAGGCC | 3793 | AD-18920, AD-19059, AD-19060, AD-18964, AD-18898, AD-18989 |
| 2590 | GCCUGGUUUGAU | 2399 | AUCAAACCAGGC | 3794 | AD-18975, AD-18920, AD-19059, AD-19060, AD-18964, AD-18898 |
| 2591 | CCUGGUUUGAUA | 2400 | UAUCAAACCAGG | 3795 | AD-18922, AD-19059, AD-19060, AD-18907, AD-18964, AD-18898 |
| 2592 | CUGGUUUGAUAC | 2401 | GUAUCAAACCAG | 3796 | AD-18922, AD-18920, AD-19060, AD-18907, AD-18964, AD-18898 |
| 2593 | UGGUUUGAUACU | 2402 | AGUAUCAAACCA | 3797 | AD-18905, AD-18922, AD-18920, AD-18907, AD-18964 |
| 2594 | GGUUUGAUACUG | 2403 | CAGUAUCAAACC | 3798 | AD-18905, AD-18920, AD-26821, AD-18907, AD-18964 |
| 2595 | GUUUGAUACUGA | 2404 | UCAGUAUCAAAC | 3799 | AD-18922, AD-18920, AD-19059, AD-26821, AD-18986 |
| 2596 | UUUGAUACUGAC | 2405 | GUCAGUAUCAAA | 3800 | AD-18905, AD-18922, AD-18920, AD-26821, AD-18907, AD-19066, AD-18986 |
| 2597 | UUGAUACUGACC | 2406 | GGUCAGUAUCAA | 3801 | AD-18905, AD-26821, AD-18907, AD-18986 |
| 2598 | UGAUACUGACCU | 2407 | AGGUCAGUAUCA | 3802 | AD-18905, AD-18999, AD-18907, AD-18965, AD-19066 |
| 2599 | GAUACUGACCUG | 2408 | CAGGUCAGUAUC | 3803 | AD-18905, AD-26821, AD-18999, AD-18965, AD-19066, AD-18986 |
| 2600 | AUACUGACCUGU | 2409 | ACAGGUCAGUAU | 3804 | AD-26822, AD-18905, AD-18965, AD-19066, AD-18986 |
| 2601 | UACUGACCUGUA | 2410 | UACAGGUCAGUA | 3805 | AD-26822, AD-26821, AD-18999, AD-18965, AD-19066, AD-18986 |

TABLE 4-continued

Groups of overlapping RNAi agents to Beta-Catenin

| Position | Sense overlap | SEQ ID NO: Anti-sense overlap | SEQ ID NO: | Overlapping groups of RNAi agents |
|---|---|---|---|---|
| 2602 | ACUGACCUGUAA | 2411 UUACAGGUCAGU | 3806 | AD-26822, AD-18999, AD-18965, AD-19066, AD-18986 |
| 2603 | CUGACCUGUAAA | 2412 UUUACAGGUCAG | 3807 | AD-26822, AD-18999, AD-18965, AD-19066 |
| 2604 | UGACCUGUAAAU | 2413 AUUUACAGGUCA | 3808 | AD-26822, AD-18999, AD-18965, AD-26823 |
| 2605 | GACCUGUAAAUC | 2414 GAUUUACAGGUC | 3809 | AD-26822, AD-26824, AD-18999, AD-26823 |
| 2606 | ACCUGUAAAUCA | 2415 UGAUUUACAGGU | 3810 | AD-26822, AD-26824, AD-26825, AD-26823 |
| 2607 | CCUGUAAAUCAU | 2416 AUGAUUUACAGG | 3811 | AD-26822, AD-26824, AD-26825, AD-26823 |
| 2608 | CUGUAAAUCAUC | 2417 GAUGAUUUACAG | 3812 | AD-26824, AD-26825, AD-26823 |
| 2609 | UGUAAAUCAUCC | 2418 GGAUGAUUUACA | 3813 | AD-26824, AD-26823 |
| 2610 | GUAAAUCAUCCU | 2419 AGGAUGAUUUAC | 3814 | AD-26825, AD-26823 |
| 2611 | UAAAUCAUCCUU | 2420 AAGGAUGAUUUA | 3815 | AD-26824, AD-26825, AD-26823 |
| 2612 | AAAUCAUCCUUU | 2421 AAAGGAUGAUUU | 3816 | AD-26824, AD-26825 |
| 2628 | GUAACAAUACAA | 2422 UUGUAUUGUUAC | 3817 | AD-18933, AD-19053 |
| 2629 | UAACAAUACAAA | 2423 UUUGUAUUGUUA | 3818 | AD-18933, AD-19053 |
| 2630 | AACAAUACAAAU | 2424 AUUUGUAUUGUU | 3819 | AD-18933, AD-19053 |
| 2631 | ACAAUACAAAUG | 2425 CAUUUGUAUUGU | 3820 | AD-18933, AD-19053 |
| 2632 | CAAUACAAAUGG | 2426 CCAUUUGUAUUG | 3821 | AD-18933, AD-19053, AD-25889 |
| 2633 | AAUACAAAUGGA | 2427 UCCAUUUGUAUU | 3822 | AD-18933, AD-25889 |
| 2634 | AUACAAAUGGAU | 2428 AUCCAUUUGUAU | 3823 | AD-18933, AD-25889 |
| 2635 | UACAAAUGGAUU | 2429 AAUCCAUUUGUA | 3824 | AD-18933, AD-25889 |
| 2636 | ACAAAUGGAUUU | 2430 AAAUCCAUUUGU | 3825 | AD-25890, AD-25889 |
| 2637 | CAAAUGGAUUUU | 2431 AAAAUCCAUUUG | 3826 | AD-25890, AD-25889 |
| 2638 | AAAUGGAUUUUG | 2432 CAAAAUCCAUUU | 3827 | AD-25890, AD-25889 |
| 2648 | UGGGAGUGACUC | 2433 GAGUCACUCCCA | 3828 | AD-25892, AD-25891 |
| 2649 | GGGAGUGACUCA | 2434 UGAGUCACUCCC | 3829 | AD-25892, AD-25891 |
| 2650 | GGAGUGACUCAA | 2435 UUGAGUCACUCC | 3830 | AD-25892, AD-25891 |
| 2651 | GAGUGACUCAAG | 2436 CUUGAGUCACUC | 3831 | AD-25892, AD-25891 |
| 2652 | AGUGACUCAAGA | 2437 UCUUGAGUCACU | 3832 | AD-25892, AD-25891 |
| 2653 | GUGACUCAAGAA | 2438 UUCUUGAGUCAC | 3833 | AD-25892, AD-25891 |
| 2654 | UGACUCAAGAAG | 2439 CUUCUUGAGUCA | 3834 | AD-25892, AD-25891 |
| 2663 | AAGUGAAGAAUG | 2440 CAUUCUUCACUU | 3835 | AD-25894, AD-25893 |
| 2664 | AGUGAAGAAUGC | 2441 GCAUUCUUCACU | 3836 | AD-25894, AD-25938 |
| 2665 | GUGAAGAAUGCA | 2442 UGCAUUCUUCAC | 3837 | AD-25893, AD-25938 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2666 | UGAAGAAUGCAC | 2443 | GUGCAUUCUUCA | 3838 | AD-25894, AD-25893 |
| 2667 | GAAGAAUGCACA | 2444 | UGUGCAUUCUUC | 3839 | AD-25894, AD-25893, AD-25938 |
| 2668 | AAGAAUGCACAA | 2445 | UUGUGCAUUCUU | 3840 | AD-25894, AD-25893, AD-25938 |
| 2669 | AGAAUGCACAAG | 2446 | CUUGUGCAUUCU | 3841 | AD-25894, AD-25893, AD-25938 |
| 2670 | GAAUGCACAAGA | 2447 | UCUUGUGCAUUC | 3842 | AD-25894, AD-25938 |
| 2682 | AUGGAUCACAAG | 2448 | CUUGUGAUCCAU | 3843 | AD-25940, AD-25939 |
| 2683 | UGGAUCACAAGA | 2449 | UCUUGUGAUCCA | 3844 | AD-25941, AD-25940, AD-25939 |
| 2684 | GGAUCACAAGAU | 2450 | AUCUUGUGAUCC | 3845 | AD-25941, AD-25940, AD-25942, AD-25939 |
| 2685 | GAUCACAAGAUG | 2451 | CAUCUUGUGAUC | 3846 | AD-25941, AD-25940, AD-25942, AD-25939, AD-25943 |
| 2686 | AUCACAAGAUGG | 2452 | CCAUCUUGUGAU | 3847 | AD-25941, AD-25940, AD-25944, AD-25942, AD-25939, AD-25943 |
| 2687 | UCACAAGAUGGA | 2453 | UCCAUCUUGUGA | 3848 | AD-25941, AD-25940, AD-25944, AD-25942, AD-25943 |
| 2688 | CACAAGAUGGAA | 2454 | UUCCAUCUUGUG | 3849 | AD-25941, AD-25944, AD-25942, AD-25939, AD-25943 |
| 2689 | ACAAGAUGGAAU | 2455 | AUUCCAUCUUGU | 3850 | AD-25941, AD-25940, AD-25944, AD-25942, AD-25943 |
| 2690 | CAAGAUGGAAUU | 2456 | AAUUCCAUCUUG | 3851 | AD-25941, AD-25944, AD-25942, AD-25943 |
| 2691 | AAGAUGGAAUUU | 2457 | AAAUUCCAUCUU | 3852 | AD-25944, AD-25942, AD-25943 |
| 2692 | AGAUGGAAUUUA | 2458 | UAAAUUCCAUCU | 3853 | AD-25944, AD-25943 |
| 2693 | GAUGGAAUUUAU | 2459 | AUAAAUUCCAUC | 3854 | AD-25944, AD-25895 |
| 2694 | AUGGAAUUUAUC | 2460 | GAUAAAUUCCAU | 3855 | AD-25895, AD-25896 |
| 2695 | UGGAAUUUAUCA | 2461 | UGAUAAAUUCCA | 3856 | AD-25895, AD-25896, AD-25945 |
| 2696 | GGAAUUUAUCAA | 2462 | UUGAUAAAUUCC | 3857 | AD-25895, AD-25896, AD-25897, AD-25945 |
| 2697 | GAAUUUAUCAAA | 2463 | UUUGAUAAAUUC | 3858 | AD-25895, AD-25896, AD-25898, AD-25897, AD-25945 |
| 2698 | AAUUUAUCAAAC | 2464 | GUUUGAUAAAUU | 3859 | AD-25895, AD-25899, AD-25896, AD-25898, AD-25945 |
| 2699 | AUUUAUCAAACC | 2465 | GGUUUGAUAAAU | 3860 | AD-25895, AD-25896, AD-25898, AD-25897, AD-25945 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2700 | UUUAUCAAACCC | 2466 | GGGUUUGAUAAA | 3861 | AD-25895, AD-25899, AD-25896, AD-25898, AD-25897, AD-25945 |
| 2701 | UUAUCAAACCCU | 2467 | AGGGUUUGAUAA | 3862 | AD-25899, AD-25896, AD-25897, AD-18929, AD-25945 |
| 2702 | UAUCAAACCCUA | 2468 | UAGGGUUUGAUA | 3863 | AD-25899, AD-25898, AD-25897, AD-18929, AD-25945 |
| 2703 | AUCAAACCCUAG | 2469 | CUAGGGUUUGAU | 3864 | AD-18996, AD-25899, AD-18915, AD-25898, AD-25897, AD-18929 |
| 2704 | UCAAACCCUAGC | 2470 | GCUAGGGUUUGA | 3865 | AD-18996, AD-25899, AD-18915, AD-25898, AD-18929 |
| 2705 | CAAACCCUAGCC | 2471 | GGCUAGGGUUUG | 3866 | AD-18935, AD-18996, AD-25899, AD-18915 |
| 2706 | AAACCCUAGCCU | 2472 | AGGCUAGGGUUU | 3867 | AD-18915, AD-18942, AD-18929 |
| 2707 | AACCCUAGCCUU | 2473 | AAGGCUAGGGUU | 3868 | AD-18913, AD-18935, AD-18996, AD-18915 |
| 2708 | ACCCUAGCCUUG | 2474 | CAAGGCUAGGGU | 3869 | AD-18913, AD-18996, AD-18915, AD-18942, AD-18929, AD-25946 |
| 2709 | CCCUAGCCUUGC | 2475 | GCAAGGCUAGGG | 3870 | AD-18913, AD-18935, AD-18996, AD-25947, AD-18915, AD-25946 |
| 2710 | CCUAGCCUUGCU | 2476 | AGCAAGGCUAGG | 3871 | AD-18913, AD-25948, AD-18935, AD-25947, AD-18915, AD-18942, AD-25946 |
| 2711 | CUAGCCUUGCUU | 2477 | AAGCAAGGCUAG | 3872 | AD-18913, AD-25948, AD-18935, AD-25949, AD-25947, AD-18942, AD-25946 |
| 2712 | UAGCCUUGCUUG | 2478 | CAAGCAAGGCUA | 3873 | AD-18913, AD-25948, AD-18935, AD-25950, AD-25947, AD-18942, AD-25946 |
| 2713 | AGCCUUGCUUGU | 2479 | ACAAGCAAGGCU | 3874 | AD-18913, AD-25948, AD-25951, AD-25949, AD-25947, AD-18942, AD-25946 |
| 2714 | GCCUUGCUUGUU | 2480 | AACAAGCAAGGC | 3875 | AD-18913, AD-25948, AD-25951, AD-25950, AD-25949, AD-25947, AD-25946 |
| 2715 | CCUUGCUUGUUA | 2481 | UAACAAGCAAGG | 3876 | AD-25948, AD-25951, AD-25950, AD-25949, AD-25947, AD-25946 |
| 2716 | CUUGCUUGUUAA | 2482 | UUAACAAGCAAG | 3877 | AD-25948, AD-25951, AD-25950, AD-25949, AD-25947 |
| 2717 | UUGCUUGUUAAA | 2483 | UUUAACAAGCAA | 3878 | AD-25948, AD-25951, AD-25950, AD-25949 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2718 | UGCUUGUUAAAU | 2484 | AUUUAACAAGCA | 3879 | AD-25951, AD-25950, AD-25949 |
| 2719 | GCUUGUUAAAUU | 2485 | AAUUUAACAAGC | 3880 | AD-25951, AD-25950 |
| 2750 | GAAUAUCUGUAA | 2486 | UUACAGAUAUUC | 3881 | AD-25900, AD-26900 |
| 2751 | AAUAUCUGUAAU | 2487 | AUUACAGAUAUU | 3882 | AD-25900, AD-26900, AD-25901 |
| 2752 | AUAUCUGUAAUG | 2488 | CAUUACAGAUAU | 3883 | AD-25900, AD-25902, AD-25901 |
| 2753 | UAUCUGUAAUGG | 2489 | CCAUUACAGAUA | 3884 | AD-25900, AD-25902, AD-25901 |
| 2754 | AUCUGUAAUGGU | 2490 | ACCAUUACAGAU | 3885 | AD-25900, AD-25901 |
| 2755 | UCUGUAAUGGUA | 2491 | UACCAUUACAGA | 3886 | AD-25902, AD-25901 |
| 2756 | CUGUAAUGGUAC | 2492 | GUACCAUUACAG | 3887 | AD-25900, AD-25902, AD-25901 |
| 2757 | UGUAAUGGUACU | 2493 | AGUACCAUUACA | 3888 | AD-25900, AD-25902 |
| 2758 | GUAAUGGUACUG | 2494 | CAGUACCAUUAC | 3889 | AD-25902, AD-25901 |
| 2832 | UUUAAGUCUCUC | 2495 | GAGAGACUUAAA | 3890 | AD-25903, AD-25904 |
| 2833 | UUAAGUCUCUCG | 2496 | CGAGAGACUUAA | 3891 | AD-25903, AD-25952, AD-25904 |
| 2834 | UAAGUCUCUCGU | 2497 | ACGAGAGACUUA | 3892 | AD-25903, AD-25952, AD-25904, AD-25953 |
| 2835 | AAGUCUCUCGUA | 2498 | UACGAGAGACUU | 3893 | AD-25954, AD-25903, AD-25952, AD-25904, AD-25953 |
| 2836 | AGUCUCUCGUAG | 2499 | CUACGAGAGACU | 3894 | AD-25954, AD-25903, AD-25952, AD-25904, AD-25953, AD-25905 |
| 2837 | GUCUCUCGUAGU | 2500 | ACUACGAGAGAC | 3895 | AD-25954, AD-25903, AD-25952, AD-25904, AD-25953 |
| 2838 | UCUCUCGUAGUG | 2501 | CACUACGAGAGA | 3896 | AD-25954, AD-25952, AD-25904, AD-25953, AD-25905 |
| 2839 | CUCUCGUAGUGU | 2502 | ACACUACGAGAG | 3897 | AD-25954, AD-25952, AD-25904, AD-25953, AD-25905 |
| 2840 | UCUCGUAGUGUU | 2503 | AACACUACGAGA | 3898 | AD-25954, AD-25952, AD-25953, AD-25905 |
| 2841 | CUCGUAGUGUUA | 2504 | UAACACUACGAG | 3899 | AD-25954, AD-25955, AD-25953, AD-25905 |
| 2842 | UCGUAGUGUUAA | 2505 | UUAACACUACGA | 3900 | AD-25954, AD-25906, AD-25955, AD-25905 |
| 2843 | CGUAGUGUUAAG | 2506 | CUUAACACUACG | 3901 | AD-25907, AD-25906, AD-25955 |
| 2844 | GUAGUGUUAAGU | 2507 | ACUUAACACUAC | 3902 | AD-25907, AD-25906, AD-25955 |
| 2845 | UAGUGUUAAGUU | 2508 | AACUUAACACUA | 3903 | AD-25907, AD-25908, AD-25906, AD-25955, AD-25909 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2846 | AGUGUUAAGUUA | 2509 | UAACUUAACACU | 3904 | AD-25907, AD-25908, AD-25956, AD-25906, AD-25955, AD-25909 |
| 2847 | GUGUUAAGUUAU | 2510 | AUAACUUAACAC | 3905 | AD-25907, AD-25908, AD-25956, AD-25957, AD-25906, AD-25955, AD-25909 |
| 2848 | UGUUAAGUUAUA | 2511 | UAUAACUUAACA | 3906 | AD-25907, AD-25908, AD-25956, AD-25957, AD-25906, AD-25909 |
| 2849 | GUUAAGUUAUAG | 2512 | CUAUAACUUAAC | 3907 | AD-25907, AD-25908, AD-25956, AD-25957, AD-25906, AD-25909 |
| 2850 | UUAAGUUAUAGU | 2513 | ACUAUAACUUAA | 3908 | AD-25907, AD-25956, AD-25957, AD-25909 |
| 2851 | UAAGUUAUAGUG | 2514 | CACUAUAACUUA | 3909 | AD-25908, AD-25956, AD-25957, AD-25909 |
| 2852 | AAGUUAUAGUGA | 2515 | UCACUAUAACUU | 3910 | AD-25956, AD-25957, AD-25909 |
| 2853 | AGUUAUAGUGAA | 2516 | UUCACUAUAACU | 3911 | AD-25956, AD-25957 |
| 2871 | UACAGCAAUUUC | 2517 | GAAAUUGCUGUA | 3912 | AD-26901, AD-25958 |
| 2872 | ACAGCAAUUUCU | 2518 | AGAAAUUGCUGU | 3913 | AD-26901, AD-25958 |
| 2873 | CAGCAAUUUCUA | 2519 | UAGAAAUUGCUG | 3914 | AD-26901, AD-25958 |
| 2874 | AGCAAUUUCUAA | 2520 | UUAGAAAUUGCU | 3915 | AD-26901, AD-25958 |
| 2875 | GCAAUUUCUAAU | 2521 | AUUAGAAAUUGC | 3916 | AD-26901, AD-25958 |
| 2876 | CAAUUUCUAAUU | 2522 | AAUUAGAAAUUG | 3917 | AD-26901, AD-25958 |
| 2877 | AAUUUCUAAUUU | 2523 | AAAUUAGAAAUU | 3918 | AD-26901, AD-25958 |
| 2901 | UAAUGGUGUAGA | 2524 | UCUACACCAUUA | 3919 | AD-18936, AD-19054 |
| 2902 | AAUGGUGUAGAA | 2525 | UUCUACACCAUU | 3920 | AD-18936, AD-19054 |
| 2903 | AUGGUGUAGAAC | 2526 | GUUCUACACCAU | 3921 | AD-18936, AD-19010, AD-19054 |
| 2904 | UGGUGUAGAACA | 2527 | UGUUCUACACCA | 3922 | AD-18936, AD-19009, AD-19010, AD-19054 |
| 2905 | GGUGUAGAACAC | 2528 | GUGUUCUACACC | 3923 | AD-18936, AD-19009, AD-18939, AD-19054 |
| 2906 | GUGUAGAACACU | 2529 | AGUGUUCUACAC | 3924 | AD-18966, AD-19009, AD-19010, AD-18939, AD-19054 |
| 2907 | UGUAGAACACUA | 2530 | UAGUGUUCUACA | 3925 | AD-18966, AD-19009, AD-18902, AD-19010, AD-18939, AD-19054 |
| 2908 | GUAGAACACUAA | 2531 | UUAGUGUUCUAC | 3926 | AD-18966, AD-19009, AD-18902, AD-19010, AD-18939, AD-19054, AD-19076 |
| 2909 | UAGAACACUAAU | 2532 | AUUAGUGUUCUA | 3927 | AD-18966, AD-19009, AD-18902, AD-19010, AD-18939, AD-19076 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2910 | AGAACACUAAUU | 2533 | AAUUAGUGUUCU | 3928 | AD-18966, AD-19009, AD-19010, AD-18939, AD-19076 |
| 2911 | GAACACUAAUUC | 2534 | GAAUUAGUGUUC | 3929 | AD-18966, AD-18902, AD-18914, AD-18939, AD-19076 |
| 2912 | AACACUAAUUCA | 2535 | UGAAUUAGUGUU | 3930 | AD-18966, AD-18902, AD-18914, AD-25911, AD-19076 |
| 2913 | ACACUAAUUCAU | 2536 | AUGAAUUAGUGU | 3931 | AD-18966, AD-18902, AD-18914, AD-25912, AD-19076 |
| 2914 | CACUAAUUCAUA | 2537 | UAUGAAUUAGUG | 3932 | AD-18902, AD-18914, AD-25912, AD-25911, AD-26902 |
| 2915 | ACUAAUUCAUAA | 2538 | UUAUGAAUUAGU | 3933 | AD-18914, AD-25912, AD-25911, AD-26903, AD-26902, AD-19076 |
| 2916 | CUAAUUCAUAAU | 2539 | AUUAUGAAUUAG | 3934 | AD-18914, AD-25912, AD-25911, AD-26903, AD-26902 |
| 2917 | UAAUUCAUAAUC | 2540 | GAUUAUGAAUUA | 3935 | AD-26916, AD-25911, AD-26903, AD-26902, AD-26904 |
| 2918 | AAUUCAUAAUCA | 2541 | UGAUUAUGAAUU | 3936 | AD-26905, AD-26916, AD-18914, AD-25912, AD-25911, AD-26903, AD-26902, AD-26904 |
| 2919 | AUUCAUAAUCAC | 2542 | GUGAUUAUGAAU | 3937 | AD-26905, AD-26916, AD-25912, AD-25911, AD-26903, AD-26902, AD-26904 |
| 2920 | UUCAUAAUCACU | 2543 | AGUGAUUAUGAA | 3938 | AD-26905, AD-26916, AD-25912, AD-26903, AD-26902, AD-26904 |
| 2921 | UCAUAAUCACUC | 2544 | GAGUGAUUAUGA | 3939 | AD-26905, AD-26916, AD-26903, AD-26902, AD-26904 |
| 2922 | CAUAAUCACUCU | 2545 | AGAGUGAUUAUG | 3940 | AD-26905, AD-26916, AD-26903, AD-26904 |
| 2923 | AUAAUCACUCUA | 2546 | UAGAGUGAUUAU | 3941 | AD-26905, AD-26916, AD-26904 |
| 2924 | UAAUCACUCUAA | 2547 | UUAGAGUGAUUA | 3942 | AD-26905, AD-26904 |
| 2938 | AAUUGUAAUCUG | 2548 | CAGAUUACAAUU | 3943 | AD-25913, AD-26906 |
| 2939 | AUUGUAAUCUGA | 2549 | UCAGAUUACAAU | 3944 | AD-25913, AD-26906, AD-25914 |
| 2940 | UUGUAAUCUGAA | 2550 | UUCAGAUUACAA | 3945 | AD-25913, AD-26906, AD-25915, AD-25914 |
| 2941 | UGUAAUCUGAAU | 2551 | AUUCAGAUUACA | 3946 | AD-25916, AD-25913, AD-26906, AD-25915, AD-25914 |
| 2942 | GUAAUCUGAAUA | 2552 | UAUUCAGAUUAC | 3947 | AD-25916, AD-25913, AD-26906, AD-25914 |

TABLE 4-continued

Groups of overlapping RNAi agents to Beta-Catenin

| Position | Sense overlap | SEQ ID NO: Anti-sense overlap | SEQ ID NO: | Overlapping groups of RNAi agents |
|---|---|---|---|---|
| 2943 | UAAUCUGAAUAA | 2553 UUAUUCAGAUUA | 3948 | AD-26906, AD-25915, AD-25914 |
| 2944 | AAUCUGAAUAAA | 2554 UUUAUUCAGAUU | 3949 | AD-25916, AD-25913, AD-26906, AD-25915, AD-25914 |
| 2945 | AUCUGAAUAAAG | 2555 CUUUAUUCAGAU | 3950 | AD-25916, AD-26906, AD-25915, AD-25914 |
| 2946 | UCUGAAUAAAGU | 2556 ACUUUAUUCAGA | 3951 | AD-25916, AD-25915, AD-25914 |
| 2947 | CUGAAUAAAGUG | 2557 CACUUUAUUCAG | 3952 | AD-25916, AD-25915 |
| 2978 | UUGUAUAAAAUA | 2558 UAUUUUAUACAA | 3953 | AD-26908, AD-26907 |
| 2979 | UGUAUAAAAUAG | 2559 CUAUUUUAUACA | 3954 | AD-26908, AD-26907, AD-26909 |
| 2980 | GUAUAAAAUAGA | 2560 UCUAUUUUAUAC | 3955 | AD-26908, AD-26909 |
| 2981 | UAUAAAAUAGAC | 2561 GUCUAUUUUAUA | 3956 | AD-26908, AD-26910, AD-26907, AD-26909 |
| 2982 | AUAAAAUAGACA | 2562 UGUCUAUUUUAU | 3957 | AD-26910, AD-26911, AD-26907, AD-26909 |
| 2983 | UAAAAUAGACAA | 2563 UUGUCUAUUUUA | 3958 | AD-26908, AD-26910, AD-26911, AD-26907, AD-26909 |
| 2984 | AAAAUAGACAAA | 2564 UUUGUCUAUUUU | 3959 | AD-26908, AD-26910, AD-26912, AD-26911, AD-26907, AD-26909 |
| 2985 | AAAUAGACAAAU | 2565 AUUUGUCUAUUU | 3960 | AD-26908, AD-26912, AD-26911, AD-26913, AD-26909 |
| 2986 | AAUAGACAAAUA | 2566 UAUUUGUCUAUU | 3961 | AD-26910, AD-26912, AD-26911, AD-26913, AD-26909 |
| 2987 | AUAGACAAAUAG | 2567 CUAUUUGUCUAU | 3962 | AD-26910, AD-26912, AD-26911, AD-26913 |
| 2988 | UAGACAAAUAGA | 2568 UCUAUUUGUCUA | 3963 | AD-26912, AD-26911 |
| 2989 | AGACAAAUAGAA | 2569 UUCUAUUUGUCU | 3964 | AD-26912, AD-26911, AD-26913 |
| 2990 | GACAAAUAGAAA | 2570 UUUCUAUUUGUC | 3965 | AD-25917, AD-26913 |
| 2991 | ACAAAUAGAAAA | 2571 UUUUCUAUUUGU | 3966 | AD-26913, AD-25918 |
| 2992 | CAAAUAGAAAAU | 2572 AUUUUCUAUUUG | 3967 | AD-25917, AD-25959, AD-25918 |
| 2993 | AAAUAGAAAAUG | 2573 CAUUUUCUAUUU | 3968 | AD-25917, AD-25959, AD-26917, AD-25918 |
| 2994 | AAUAGAAAAUGG | 2574 CCAUUUUCUAUU | 3969 | AD-25917, AD-26918, AD-25959, AD-26917 |
| 2995 | AUAGAAAAUGGU | 2575 ACCAUUUUCUAU | 3970 | AD-25917, AD-26918, AD-25959, AD-26917, AD-25918, AD-25960 |
| 2996 | UAGAAAAUGGUC | 2576 GACCAUUUUCUA | 3971 | AD-25917, AD-26918, AD-25959, AD-26917, AD-25919, AD-25918, AD-25960 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 2997 | AGAAAAUGGUCC | 2577 | GGACCAUUUUCU | 3972 | AD-25917, AD-26918, AD-25920, AD-25959, AD-26917, AD-25919, AD-25918, AD-25960 |
| 2998 | GAAAAUGGUCCA | 2578 | UGGACCAUUUUC | 3973 | AD-26918, AD-25920, AD-25959, AD-26917, AD-25919, AD-25918, AD-25960 |
| 2999 | AAAAUGGUCCAA | 2579 | UUGGACCAUUUU | 3974 | AD-26918, AD-25920, AD-25959, AD-26917, AD-25919, AD-25960 |
| 3000 | AAAUGGUCCAAU | 2580 | AUUGGACCAUUU | 3975 | AD-26918, AD-25920, AD-26917, AD-25919, AD-25960 |
| 3001 | AAUGGUCCAAUU | 2581 | AAUUGGACCAUU | 3976 | AD-26918, AD-25920, AD-25919, AD-25960 |
| 3002 | AUGGUCCAAUUA | 2582 | UAAUUGGACCAU | 3977 | AD-25920, AD-25919, AD-25960 |
| 3003 | UGGUCCAAUUAG | 2583 | CUAAUUGGACCA | 3978 | AD-25920, AD-25919 |
| 3028 | AUGCUUAAAAUA | 2584 | UAUUUUAAGCAU | 3979 | AD-18985, AD-18992 |
| 3029 | UGCUUAAAAUAA | 2585 | UUAUUUUAAGCA | 3980 | AD-18985, AD-18992 |
| 3030 | GCUUAAAAUAAG | 2586 | CUUAUUUUAAGC | 3981 | AD-18985, AD-18992 |
| 3031 | CUUAAAAUAAGC | 2587 | GCUUAUUUUAAG | 3982 | AD-18985, AD-18992, AD-19081 |
| 3032 | UUAAAAUAAGCA | 2588 | UGCUUAUUUUAA | 3983 | AD-18985, AD-19081 |
| 3033 | UAAAAUAAGCAG | 2589 | CUGCUUAUUUUA | 3984 | AD-18985, AD-18992, AD-19081, AD-19044 |
| 3034 | AAAAUAAGCAGG | 2590 | CCUGCUUAUUUU | 3985 | AD-18985, AD-18992, AD-19081 |
| 3035 | AAAUAAGCAGGU | 2591 | ACCUGCUUAUUU | 3986 | AD-18985, AD-19044 |
| 3036 | AAUAAGCAGGUG | 2592 | CACCUGCUUAUU | 3987 | AD-18993, AD-19081, AD-19044 |
| 3037 | AUAAGCAGGUGG | 2593 | CCACCUGCUUAU | 3988 | AD-18993, AD-18894, AD-19081, AD-19044 |
| 3038 | UAAGCAGGUGGA | 2594 | UCCACCUGCUUA | 3989 | AD-19043, AD-18993, AD-18894, AD-19044 |
| 3039 | AAGCAGGUGGAU | 2595 | AUCCACCUGCUU | 3990 | AD-19043, AD-18956, AD-18993, AD-18894 |
| 3040 | AGCAGGUGGAUC | 2596 | GAUCCACCUGCU | 3991 | AD-19043, AD-18956, AD-18993, AD-18894, AD-19044, AD-18958 |
| 3041 | GCAGGUGGAUCU | 2597 | AGAUCCACCUGC | 3992 | AD-19043, AD-18956, AD-18993, AD-18894, AD-18958 |
| 3042 | CAGGUGGAUCUA | 2598 | UAGAUCCACCUG | 3993 | AD-19043, AD-18956, AD-18894, AD-18969, AD-18958, AD-19058 |
| 3043 | AGGUGGAUCUAU | 2599 | AUAGAUCCACCU | 3994 | AD-19069, AD-19043, AD-18956, AD-18993, AD-18894, AD-18969, AD-18958, AD-19058 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 3044 | GGUGGAUCUAUU | 2600 | AAUAGAUCCACC | 3995 | AD-19069, AD-19043, AD-18956, AD-18894, AD-18969, AD-18958, AD-19058 |
| 3045 | GUGGAUCUAUUU | 2601 | AAAUAGAUCCAC | 3996 | AD-19069, AD-19043, AD-18956, AD-18969, AD-18958, AD-19058 |
| 3046 | UGGAUCUAUUUC | 2602 | GAAAUAGAUCCA | 3997 | AD-19069, AD-18956, AD-18969, AD-18958, AD-19058 |
| 3047 | GGAUCUAUUUCA | 2603 | UGAAAUAGAUCC | 3998 | AD-19069, AD-18969, AD-18958, AD-19058 |
| 3048 | GAUCUAUUUCAU | 2604 | AUGAAAUAGAUC | 3999 | AD-19069, AD-18969, AD-19058 |
| 3049 | AUCUAUUUCAUG | 2605 | CAUGAAAUAGAU | 4000 | AD-19069, AD-19058 |
| 3077 | AUUUGGGAUAUG | 2606 | CAUAUCCCAAAU | 4001 | AD-25921, AD-25922 |
| 3078 | UUUGGGAUAUGU | 2607 | ACAUAUCCCAAA | 4002 | AD-25961, AD-25921, AD-25922 |
| 3079 | UUGGGAUAUGUA | 2608 | UACAUAUCCCAA | 4003 | AD-25961, AD-25923, AD-25921, AD-25922 |
| 3080 | UGGGAUAUGUAU | 2609 | AUACAUAUCCCA | 4004 | AD-25961, AD-25923, AD-26914, AD-25921, AD-25922 |
| 3081 | GGGAUAUGUAUG | 2610 | CAUACAUAUCCC | 4005 | AD-25961, AD-25923, AD-26915, AD-26914, AD-25921, AD-25922 |
| 3082 | GGAUAUGUAUGG | 2611 | CCAUACAUAUCC | 4006 | AD-25961, AD-25923, AD-25924, AD-26915, AD-26914, AD-25921, AD-25922 |
| 3083 | GAUAUGUAUGGG | 2612 | CCCAUACAUAUC | 4007 | AD-25961, AD-25923, AD-25924, AD-26915, AD-25962, AD-26914, AD-25921, AD-25922 |
| 3084 | AUAUGUAUGGGU | 2613 | ACCCAUACAUAU | 4008 | AD-25961, AD-25923, AD-25924, AD-26915, AD-25962, AD-26914, AD-25922 |
| 3085 | UAUGUAUGGGUA | 2614 | UACCCAUACAUA | 4009 | AD-25961, AD-25923, AD-25924, AD-26915, AD-25962, AD-26914 |
| 3086 | AUGUAUGGGUAG | 2615 | CUACCCAUACAU | 4010 | AD-25923, AD-25924, AD-26915, AD-25962, AD-26914 |
| 3087 | UGUAUGGGUAGG | 2616 | CCUACCCAUACA | 4011 | AD-25924, AD-26915, AD-25962, AD-26914 |
| 3088 | GUAUGGGUAGGG | 2617 | CCCUACCCAUAC | 4012 | AD-25924, AD-26915, AD-25962 |
| 3089 | UAUGGGUAGGGU | 2618 | ACCCUACCCAUA | 4013 | AD-25924, AD-25962 |
| 3093 | GGUAGGGUAAAU | 2619 | AUUUACCCUACC | 4014 | AD-18998, AD-25963 |
| 3094 | GUAGGGUAAAUC | 2620 | GAUUUACCCUAC | 4015 | AD-18998, AD-25963, AD-18995 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 3095 | UAGGGUAAAUCA | 2621 | UGAUUUACCCUA | 4016 | AD-18998, AD-25963, AD-18995 |
| 3096 | AGGGUAAAUCAG | 2622 | CUGAUUUACCCU | 4017 | AD-18998, AD-25963, AD-18995 |
| 3097 | GGGUAAAUCAGU | 2623 | ACUGAUUUACCC | 4018 | AD-18998, AD-25963, AD-18981, AD-18995 |
| 3098 | GGUAAAUCAGUA | 2624 | UACUGAUUUACC | 4019 | AD-18921, AD-18998, AD-25963, AD-18981, AD-18995 |
| 3099 | GUAAAUCAGUAA | 2625 | UUACUGAUUUAC | 4020 | AD-18921, AD-18998, AD-18981, AD-18995 |
| 3100 | UAAAUCAGUAAG | 2626 | CUUACUGAUUUA | 4021 | AD-18921, AD-18998, AD-18981, AD-19050, AD-18995 |
| 3101 | AAAUCAGUAAGA | 2627 | UCUUACUGAUUU | 4022 | AD-18921, AD-18968, AD-18981, AD-19050 |
| 3102 | AAUCAGUAAGAG | 2628 | CUCUUACUGAUU | 4023 | AD-18921, AD-18968, AD-18981, AD-19050, AD-19005 |
| 3103 | AUCAGUAAGAGG | 2629 | CCUCUUACUGAU | 4024 | AD-18921, AD-18968, AD-18981, AD-19050, AD-18903, AD-19005 |
| 3104 | UCAGUAAGAGGU | 2630 | ACCUCUUACUGA | 4025 | AD-18921, AD-18968, AD-18972, AD-18981, AD-19050, AD-18903, AD-19005 |
| 3105 | CAGUAAGAGGUG | 2631 | CACCUCUUACUG | 4026 | AD-18921, AD-18968, AD-18972, AD-19050, AD-18903, AD-19005 |
| 3106 | AGUAAGAGGUGU | 2632 | ACACCUCUUACU | 4027 | AD-18968, AD-19050, AD-18903, AD-19005 |
| 3107 | GUAAGAGGUGUU | 2633 | AACACCUCUUAC | 4028 | AD-18972, AD-19050, AD-18903, AD-19005 |
| 3108 | UAAGAGGUGUUA | 2634 | UAACACCUCUUA | 4029 | AD-18968, AD-18972, AD-18903, AD-25964, AD-19005 |
| 3109 | AAGAGGUGUUAU | 2635 | AUAACACCUCUU | 4030 | AD-18972, AD-18903, AD-25964, AD-19005 |
| 3110 | AGAGGUGUUAUU | 2636 | AAUAACACCUCU | 4031 | AD-18972, AD-18903, AD-25925, AD-25926, AD-25964 |
| 3111 | GAGGUGUUAUUU | 2637 | AAAUAACACCUC | 4032 | AD-25925, AD-25926, AD-25964 |
| 3112 | AGGUGUUAUUUG | 2638 | CAAAUAACACCU | 4033 | AD-25927, AD-25925, AD-25926, AD-25964 |
| 3113 | GGUGUUAUUUGG | 2639 | CCAAAUAACACC | 4034 | AD-25927, AD-25926, AD-25964 |
| 3114 | GUGUUAUUUGGA | 2640 | UCCAAAUAACAC | 4035 | AD-25927, AD-25925, AD-25926, AD-25964 |
| 3115 | UGUUAUUUGGAA | 2641 | UUCCAAAUAACA | 4036 | AD-25925, AD-25926, AD-25964 |

TABLE 4-continued

Groups of overlapping RNAi agents to Beta-Catenin

| Position | Sense overlap | SEQ ID NO: Anti-sense overlap | SEQ ID NO: | Overlapping groups of RNAi agents |
|---|---|---|---|---|
| 3116 | GUUAUUUGGAAC | 2642 GUUCCAAAUAAC | 4037 | AD-25927, AD-25925, AD-25926 |
| 3117 | UUAUUUGGAACC | 2643 GGUUCCAAAUAA | 4038 | AD-25927, AD-25926 |
| 3123 | GGAACCUUGUUU | 2644 AAACAAGGUUCC | 4039 | AD-25929, AD-25928 |
| 3124 | GAACCUUGUUUU | 2645 AAAACAAGGUUC | 4040 | AD-25930, AD-25928 |
| 3125 | AACCUUGUUUUG | 2646 CAAAACAAGGUU | 4041 | AD-25930, AD-25929, AD-25928 |
| 3126 | ACCUUGUUUUGG | 2647 CCAAAACAAGGU | 4042 | AD-25930, AD-25929 |
| 3127 | CCUUGUUUUGGA | 2648 UCCAAAACAAGG | 4043 | AD-25930, AD-25929, AD-25928 |
| 3128 | CUUGUUUUGGAC | 2649 GUCCAAAACAAG | 4044 | AD-25930, AD-25929, AD-25928 |
| 3129 | UUGUUUUGGACA | 2650 UGUCCAAAACAA | 4045 | AD-25929, AD-25928 |
| 3130 | UGUUUUGGACAG | 2651 CUGUCCAAAACA | 4046 | AD-25930, AD-25929 |
| 3131 | GUUUUGGACAGU | 2652 ACUGUCCAAAAC | 4047 | AD-25930, AD-25931 |
| 3132 | UUUUGGACAGUU | 2653 AACUGUCCAAAA | 4048 | AD-25932, AD-25931 |
| 3133 | UUUGGACAGUUU | 2654 AAACUGUCCAAA | 4049 | AD-25932, AD-26919, AD-25931 |
| 3134 | UUGGACAGUUUA | 2655 UAAACUGUCCAA | 4050 | AD-25933, AD-26919, AD-25931 |
| 3135 | UGGACAGUUUAC | 2656 GUAAACUGUCCA | 4051 | AD-25933, AD-25932, AD-26919, AD-25931 |
| 3136 | GGACAGUUUACC | 2657 GGUAAACUGUCC | 4052 | AD-25933, AD-25932, AD-25931 |
| 3137 | GACAGUUUACCA | 2658 UGGUAAACUGUC | 4053 | AD-25932, AD-26919, AD-25931 |
| 3138 | ACAGUUUACCAG | 2659 CUGGUAAACUGU | 4054 | AD-25933, AD-25932, AD-26919, AD-25931 |
| 3139 | CAGUUUACCAGU | 2660 ACUGGUAAACUG | 4055 | AD-25933, AD-25932, AD-26919 |
| 3140 | AGUUUACCAGUU | 2661 AACUGGUAAACU | 4056 | AD-25933, AD-26919 |
| 3145 | ACCAGUUGCCUU | 2662 AAGGCAACUGGU | 4057 | AD-18940, AD-18916 |
| 3146 | CCAGUUGCCUUU | 2663 AAAGGCAACUGG | 4058 | AD-18940, AD-18906, AD-18916 |
| 3147 | CAGUUGCCUUUU | 2664 AAAAGGCAACUG | 4059 | AD-18940, AD-18906, AD-18916 |
| 3148 | AGUUGCCUUUUA | 2665 UAAAAGGCAACU | 4060 | AD-18940, AD-19075, AD-18916 |
| 3149 | GUUGCCUUUUAU | 2666 AUAAAAGGCAAC | 4061 | AD-19075, AD-18906, AD-18916 |
| 3150 | UUGCCUUUUAUC | 2667 GAUAAAAGGCAA | 4062 | AD-18940, AD-19075, AD-18906, AD-18916 |
| 3151 | UGCCUUUUAUCC | 2668 GGAUAAAAGGCA | 4063 | AD-18940, AD-19075, AD-18906, AD-18916 |
| 3152 | GCCUUUUAUCCC | 2669 GGGAUAAAAGGC | 4064 | AD-18906, AD-18916 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 3153 | CCUUUUAUCCCA | 2670 | UGGGAUAAAAGG | 4065 | AD-26017, AD-19075, AD-18906, AD-18997 |
| 3154 | CUUUUAUCCCAA | 2671 | UUGGGAUAAAAG | 4066 | AD-26017, AD-19075, AD-18997 |
| 3155 | UUUUAUCCCAAA | 2672 | UUUGGGAUAAAA | 4067 | AD-26017, AD-18997 |
| 3156 | UUUAUCCCAAAG | 2673 | CUUUGGGAUAAA | 4068 | AD-26017, AD-18997 |
| 3157 | UUAUCCCAAAGU | 2674 | ACUUUGGGAUAA | 4069 | AD-26017, AD-18997 |
| 3158 | UAUCCCAAAGUU | 2675 | AACUUUGGGAUA | 4070 | AD-26017, AD-18997, AD-18988 |
| 3159 | AUCCCAAAGUUG | 2676 | CAACUUUGGGAU | 4071 | AD-18997, AD-18988 |
| 3160 | UCCCAAAGUUGU | 2677 | ACAACUUUGGGA | 4072 | AD-19067, AD-18997, AD-18988 |
| 3161 | CCCAAAGUUGUU | 2678 | AACAACUUUGGG | 4073 | AD-19067, AD-19083 |
| 3162 | CCAAAGUUGUUG | 2679 | CAACAACUUUGG | 4074 | AD-19083, AD-18988 |
| 3163 | CAAAGUUGUUGU | 2680 | ACAACAACUUUG | 4075 | AD-19067, AD-19083, AD-19049, AD-18988 |
| 3164 | AAAGUUGUUGUA | 2681 | UACAACAACUUU | 4076 | AD-19067, AD-19083, AD-18952, AD-19049, AD-18988 |
| 3165 | AAGUUGUUGUAA | 2682 | UUACAACAACUU | 4077 | AD-19067, AD-19083, AD-18957, AD-18952, AD-19049, AD-18988 |
| 3166 | AGUUGUUGUAAC | 2683 | GUUACAACAACU | 4078 | AD-19067, AD-19083, AD-18957, AD-18952, AD-19049 |
| 3167 | GUUGUUGUAACC | 2684 | GGUUACAACAAC | 4079 | AD-19067, AD-19083, AD-18957, AD-25934, AD-18952, AD-19049 |
| 3168 | UUGUUGUAACCU | 2685 | AGGUUACAACAA | 4080 | AD-19083, AD-18957, AD-25934, AD-18952, AD-25935, AD-19049 |
| 3169 | UGUUGUAACCUG | 2686 | CAGGUUACAACA | 4081 | AD-18957, AD-25934, AD-18952, AD-26018, AD-25935, AD-19049 |
| 3170 | GUUGUAACCUGC | 2687 | GCAGGUUACAAC | 4082 | AD-26019, AD-18957, AD-25934, AD-18952, AD-26018, AD-25935, AD-19049 |
| 3171 | UUGUAACCUGCU | 2688 | AGCAGGUUACAA | 4083 | AD-26019, AD-18957, AD-25936, AD-25934, AD-18952, AD-26018, AD-25935 |
| 3172 | UGUAACCUGCUG | 2689 | CAGCAGGUUACA | 4084 | AD-26019, AD-18957, AD-25936, AD-25934, AD-26018, AD-25935 |
| 3173 | GUAACCUGCUGU | 2690 | ACAGCAGGUUAC | 4085 | AD-26019, AD-25936, AD-25934, AD-26018 |
| 3174 | UAACCUGCUGUG | 2691 | CACAGCAGGUUA | 4086 | AD-26019, AD-25936, AD-25934, AD-26018, AD-25935 |
| 3175 | AACCUGCUGUGA | 2692 | UCACAGCAGGUU | 4087 | AD-26019, AD-25936, AD-26018, AD-25935 |

TABLE 4-continued

Groups of overlapping RNAi agents to Beta-Catenin

| Position | Sense overlap | SEQ ID NO: | Anti-sense overlap | SEQ ID NO: | Overlapping groups of RNAi agents |
|---|---|---|---|---|---|
| 3176 | ACCUGCUGUGAU | 2693 | AUCACAGCAGGU | 4088 | AD-26019, AD-25936, AD-26018 |
| 3177 | CCUGCUGUGAUA | 2694 | UAUCACAGCAGG | 4089 | AD-26019, AD-25936 |
| 3197 | CAAGAGAAAAUG | 2695 | CAUUUUCUCUUG | 4090 | AD-26020, AD-25937 |
| 3198 | AAGAGAAAAUGC | 2696 | GCAUUUUCUCUU | 4091 | AD-26020, AD-26021, AD-25937 |
| 3199 | AGAGAAAAUGCG | 2697 | CGCAUUUUCUCU | 4092 | AD-26020, AD-26021 |
| 3200 | GAGAAAAUGCGG | 2698 | CCGCAUUUUCUC | 4093 | AD-26020, AD-26021 |
| 3201 | AGAAAAUGCGGU | 2699 | ACCGCAUUUUCU | 4094 | AD-26020, AD-26021 |
| 3202 | GAAAAUGCGGUU | 2700 | AACCGCAUUUUC | 4095 | AD-26020, AD-26021 |
| 3203 | AAAAUGCGGUUA | 2701 | UAACCGCAUUUU | 4096 | AD-26020, AD-26021 |
| 3204 | AAAUGCGGUUAU | 2702 | AUAACCGCAUUU | 4097 | AD-26020, AD-26021 |
| 3220 | AAUGGUUCAGAA | 2703 | UUCUGAACCAUU | 4098 | AD-18960, AD-18987 |
| 3221 | AUGGUUCAGAAU | 2704 | AUUCUGAACCAU | 4099 | AD-18960, AD-18987, AD-19008 |
| 3222 | UGGUUCAGAAUU | 2705 | AAUUCUGAACCA | 4100 | AD-18960, AD-18987, AD-19008 |
| 3223 | GGUUCAGAAUUA | 2706 | UAAUUCUGAACC | 4101 | AD-18980, AD-18987, AD-19008 |
| 3224 | GUUCAGAAUUAA | 2707 | UUAAUUCUGAAC | 4102 | AD-18960, AD-18987, AD-19008 |
| 3225 | UUCAGAAUUAAA | 2708 | UUUAAUUCUGAA | 4103 | AD-18960, AD-18980, AD-19008 |
| 3226 | UCAGAAUUAAAC | 2709 | GUUUAAUUCUGA | 4104 | AD-18960, AD-18980, AD-18987, AD-19008 |
| 3227 | CAGAAUUAAACU | 2710 | AGUUUAAUUCUG | 4105 | AD-18980, AD-18987, AD-19008 |
| 3228 | AGAAUUAAACUU | 2711 | AAGUUUAAUUCU | 4106 | AD-18980, AD-19008 |
| 3229 | GAAUUAAACUUU | 2712 | AAAGUUUAAUUC | 4107 | AD-18980, AD-19007 |
| 3230 | AAUUAAACUUUU | 2713 | AAAAGUUUAAUU | 4108 | AD-18980, AD-19007 |

Example 2

Synthesis of Beta-Catenin RNAi Agent Sequences
Beta-Catenin RNAi Agent Sequence Selection
479 sense and 479 anti-sense CTNNB1-derived RNAi agent oligos listed herein are synthesized and formed into duplexes.
Synthesis of Beta-Catenin Sequences
Synthesis:
Beta-Catenin sequences are synthesized on MerMade 192 synthesizer at 1 µmol scale.
958 single strand sequences (corresponding to 479 RNAi agent duplexes) are synthesized for the human Beta-Catenin gene. For all the sequences, 'endolight' chemistry is applied as detailed below.
All pyrimidines (cytosine and uridine) in the sense strand are replaced with corresponding 2'-O-Methyl bases (2' O-Methyl C and 2'-O-Methyl U)

In the anti-sense strand, pyrimidines (C and U) adjacent to (towards 5' position) ribo A nucleoside are replaced with their corresponding 2-O-Methyl nucleosides
A two base dTdT extension at 3' end of both sense and anti-sense sequences is introduced. This two base overhang has a phosphodiester linkage
The sequence file is converted to a text file to make it compatible for loading in the MerMade 192 synthesis software
The synthesis of Beta-Catenin sequences uses solid supported oligonucleotide synthesis using phosphoramidite chemistry
The synthesis of the above sequences is performed at 1 µm scale in 96-well plates and 192 sequences are made per run. The amidite solutions are prepared at 0.1M concentration and ethyl thio tetrazole (0.6M in acetonitrile) is used as activator.

Cleavage and De-Protection:

The synthesized sequences are cleaved and de-protected in 96-well plates, using methylamine in the first step and triethylamine $^3$HF in the second step. The crude sequences thus obtained are precipitated using acetone: ethanol mix and the pellet is re-suspended in 0.02M sodium acetate buffer. Samples from each sequence are analyzed by LC-MS and the resulting mass data confirms the identity of the sequences. A selected set of samples are also analyzed by IEX chromatography.

Purification:

Next step in the process is purification. All sequences are purified on AKTA explorer purification system using Source 15Q column. Purification is performed using a column and in-line buffer heater set at 60° C. A single peak corresponding to the full length sequence is collected in the eluent and is subsequently analyzed for purity by ion exchange chromatography.

The purified sequences are desalted on a Sephadex G25 column using AKTA purifier. The desalted Beta-Catenin sequences are analyzed for concentration and purity. The single strands are then annealed to form RNAi agent duplexes. Each duplex is made at a concentration of 10 μM in 1×PBS.

A detailed list of Beta-Catenin single strands and duplexes are shown herein, in Example 1, above. The duplexes are used in in vitro screening to test their ability to knock down Beta-Catenin gene level, Example 3, below.

Example 3

In Vitro Screening of Beta-Catenin RNAi Agents
In Vitro Screening:

RNAi agents listed herein (Example 1) and synthesized as described in Example 2, are tested for activity in vitro.

Cell Culture and Transfections:

HeLa cells (ATCC, Manassas, Va.) are grown to near confluence at 37° C. in an atmosphere of 5% $CO_2$ in Eagle's Minimum Essential Medium (EMEM, ATCC) supplemented with 10% FBS, streptomycin, and glutamine (ATCC) before being released from the plate by trypsinization. Reverse transfection is carried out by adding 5 μl of Opti-MEM to 5 μl of RNAi agent duplexes per well into a 96-well plate along with 10 μl of Opti-MEM plus 0.2 μl of Lipofectamine RNAiMax per well (Invitrogen, Carlsbad, Calif. cat #13778-150) and incubated at room temperature for 15 minutes. For assays performed at 24 hours, 80 μl of complete growth media without antibiotic containing ~2×10$^4$ HeLa cells are then added to the RNAi agent mixture. For assays performed at 120 hours, 80 μl of complete growth media without antibiotic containing ~2×10$^4$ HeLa cells are then added to the RNAi agent mixture. Cells are incubated for either 24 or 48 hours prior to RNA purification. Single dose experiments are performed at 10 nM and in some cases 0.1 nM final duplex concentration and dose response experiments are done at 10, 1, 0.5, 0.1, 0.05, 0.01, 0.005, 0.001, 0.0005, 0.0001, 0.00005, 0.00001 nM final duplex concentration.

Total RNA Isolation Using MagMAX-96 Total RNA Isolation Kit (Applied Biosystem, Foster City Calif., Part #: AM1830):

Cells are harvested and lysed in 140 μl of Lysis/Binding Solution then mixed for 1 minute at 850 rpm using and Eppendorf Thermomixer (the mixing speed is the same throughout the process). Twenty micro liters of magnetic beads and Lysis/Binding Enhancer mixture are added into cell-lysate and mixed for 5 minutes. Magnetic beads are captured using magnetic stand and the supernatant is removed without disturbing the beads. After removing supernatant, magnetic beads are washed with Wash Solution 1 (isopropanol added) and mixed for 1 minute. Beads are captured again and supernatant removed. Beads are then washed with 150 μl Wash Solution 2 (Ethanol added), captured and supernatant is removed. 50 μl of DNase mixture (MagMax turbo DNase Buffer and Turbo DNase) is then added to the beads and they are mixed for 10 to 15 minutes. After mixing, 100 μl of RNA Rebinding Solution is added and mixed for 3 minutes. Supernatant is removed and magnetic beads are washed again with 150 μl Wash Solution 2 and mixed for 1 minute and supernatant is removed completely. The magnetic beads are mixed for 2 minutes to dry before RNA is eluted with 50 μl of water.

cDNA Synthesis Using ABI High Capacity cDNA Reverse Transcription Kit (Applied Biosystems, Foster City, Calif., Cat #4368813):

A master mix of 2 μl 10× Buffer, 0.8 μl 25× dNTPs, 2 μl Random primers, 1 μl Reverse Transcriptase, 1 μl RNase inhibitor and 3.2 μl of $H_2O$ per reaction are added into 10 μl total RNA. cDNA is generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR:

2 μl of cDNA are added to a master mix containing 1 μl 18S TaqMan Probe (Applied Biosystems Cat #4319413E), 1 ul β-catenin TaqMan probe (Applied Biosystems cat # HS00170025_m1) and 10 μl TaqMan Universal PCR Master Mix (Applied Biosystems Cat #4324018) per well in a MicroAmp Optical 96 well plate (Applied Biosystems cat #4326659). Real time PCR is done in an ABI 7900HT Real Time PCR system (Applied Biosystems) using the ΔΔCt (RQ) assay. Each duplex is tested in two independent transfections and each transfections is assayed in duplicate, unless otherwise noted in the summary tables.

Real time data are analyzed using the ΔΔCt method and normalized to assays performed with cells transfected with 10 nM AD-1955 (a control RNAi agent that does not bind to Beta-Catenin) to calculate relative fold-change.

The results are shown below. Table 5 shows the results of experiments performed at 0.1 or 10 nM final duplex concentration for single dose screens with each of the Beta-Catenin duplexes. The "Residual Gene Activity" (Fold-Change) indicates the residual gene level, at 10 nm or 0.1 nM. Thus, for AD-18892, a "Residual Gene Activity" at 10 nM at 24 hr of 0.054 indicates 5.4% remaining gene activity, or 94.6% gene knock-down. The Avg. EC50 (nM) indicates the estimated EC50 (concentration estimated to give 50% gene knock-down in HeLa cells), as calculated from available data collected at 10 nM, 1 nM, 0.1 nM, 0.01 nM, and 0.001 nM. "NA" indicates data is not available.

TABLE 5

Analysis of RNAi agents to Beta-Catenin

| Duplex | Sense SEQ ID NO: | Anti-sense SEQ ID NO: | Residual Gene Activity 10 nM 24 hr | Residual Gene Activity 0.1 nM 120 hr | Avg. EC50 (nM) |
|---|---|---|---|---|---|
| AD-18892 | 1 | 6497 | 0.054 | 0.47 | NA |
| AD-18893 | 2 | 661 | 0.026 | NA | 0.008 |
| AD-18894 | 3 | 662 | 0.068 | NA | 0.005 |
| AD-18895 | 4 | 663 | 0.466 | NA | NA |
| AD-18896 | 5 | 664 | 0.244 | NA | NA |
| AD-18897 | 6 | 665 | 0.054 | NA | 0.028 |
| AD-18898 | 7 | 666 | 0.903 | NA | NA |
| AD-18899 | 8 | 667 | 0.301 | NA | NA |

TABLE 5-continued

Analysis of RNAi agents to Beta-Catenin

| Duplex | Sense SEQ ID NO: | Anti-sense SEQ ID NO: | Residual Gene Activity 10 nM 24 hr | Residual Gene Activity 0.1 nM 120 hr | Avg. EC50 (nM) |
|---|---|---|---|---|---|
| AD-18900 | 9 | 668 | 1.157 | NA | NA |
| AD-18901 | 10 | 669 | 0.359 | NA | NA |
| AD-18902 | 11 | 670 | 0.058 | NA | 0.005 |
| AD-18903 | 12 | 671 | 0.052 | NA | 0.002 |
| AD-18904 | 13 | 672 | 0.690 | NA | NA |
| AD-18905 | 14 | 673 | 0.198 | NA | 1.260 |
| AD-18906 | 15 | 674 | 0.248 | NA | NA |
| AD-18907 | 16 | 675 | 0.379 | NA | NA |
| AD-18908 | 17 | 676 | 0.157 | NA | NA |
| AD-18909 | 18 | 677 | 0.441 | NA | NA |
| AD-18910 | 19 | 678 | 0.385 | NA | NA |
| AD-18911 | 20 | 679 | 0.186 | NA | 1.664 |
| AD-18912 | 21 | 680 | 0.221 | NA | NA |
| AD-18913 | 22 | 681 | 0.124 | NA | 0.018 |
| AD-18914 | 23 | 682 | 0.058 | NA | 0.002 |
| AD-18915 | 24 | 683 | 0.242 | NA | NA |
| AD-18916 | 25 | 684 | 0.530 | NA | NA |
| AD-18917 | 26 | 685 | 0.527 | 0.66 | NA |
| AD-18918 | 27 | 686 | 1.161 | NA | NA |
| AD-18919 | 28 | 687 | 0.387 | NA | NA |
| AD-18920 | 29 | 688 | 1.124 | NA | NA |
| AD-18921 | 30 | 689 | 0.752 | NA | NA |
| AD-18922 | 31 | 690 | 0.587 | NA | NA |
| AD-18923 | 32 | 691 | 0.773 | NA | NA |
| AD-18925 | 33 | 692 | 0.738 | NA | NA |
| AD-18926 | 34 | 693 | 0.193 | NA | 0.033 |
| AD-18927 | 35 | 694 | 0.091 | NA | 0.764 |
| AD-18928 | 36 | 695 | 0.228 | NA | NA |
| AD-18929 | 37 | 696 | 0.069 | NA | NA |
| AD-18930 | 38 | 697 | 0.428 | NA | NA |
| AD-18931 | 39 | 698 | 1.195 | NA | NA |
| AD-18932 | 40 | 699 | 0.876 | NA | NA |
| AD-18933 | 41 | 700 | 0.047 | NA | 0.001 |
| AD-18934 | 42 | 701 | 0.651 | NA | NA |
| AD-18935 | 43 | 702 | 0.419 | NA | NA |
| AD-18936 | 44 | 703 | 0.125 | NA | 0.158 |
| AD-18937 | 45 | 704 | 0.839 | NA | NA |
| AD-18938 | 46 | 705 | 0.436 | NA | NA |
| AD-18939 | 47 | 706 | 0.068 | NA | 0.011 |
| AD-18940 | 48 | 707 | 0.515 | NA | NA |
| AD-18941 | 49 | 708 | 0.421 | NA | NA |
| AD-18942 | 50 | 709 | 1.397 | NA | NA |
| AD-18943 | 51 | 710 | 0.990 | NA | NA |
| AD-18944 | 52 | 711 | 0.550 | NA | NA |
| AD-18945 | 53 | 712 | 0.193 | NA | 0.780 |
| AD-18946 | 54 | 713 | 0.086 | 0.47 | NA |
| AD-18947 | 55 | 714 | 0.397 | NA | NA |
| AD-18948 | 56 | 715 | 0.885 | NA | NA |
| AD-18949 | 57 | 716 | 0.863 | NA | NA |
| AD-18950 | 58 | 717 | 0.103 | NA | 0.145 |
| AD-18951 | 59 | 718 | 0.184 | NA | 0.519 |
| AD-18952 | 60 | 719 | 0.382 | NA | NA |
| AD-18953 | 61 | 720 | 1.349 | NA | NA |
| AD-18954 | 62 | 721 | 0.766 | NA | NA |
| AD-18955 | 63 | 722 | 0.649 | 0.64 | NA |
| AD-18956 | 64 | 723 | 0.240 | NA | NA |
| AD-18957 | 65 | 724 | 1.198 | NA | NA |
| AD-18958 | 66 | 725 | 0.083 | NA | 0.012 |
| AD-18959 | 67 | 726 | 0.713 | NA | NA |
| AD-18960 | 68 | 727 | 0.188 | NA | 0.310 |
| AD-18961 | 69 | 728 | 0.105 | NA | 0.209 |
| AD-18962 | 70 | 729 | 0.942 | NA | NA |
| AD-18963 | 71 | 730 | 0.037 | 0.37 | 0.049 |
| AD-18964 | 72 | 731 | 0.907 | NA | NA |
| AD-18965 | 73 | 732 | 0.440 | 0.48 | NA |
| AD-18966 | 74 | 733 | 0.042 | NA | 0.000 |
| AD-18967 | 75 | 734 | 0.695 | NA | NA |
| AD-18968 | 76 | 735 | 0.158 | NA | 0.134 |
| AD-18969 | 77 | 736 | 0.073 | NA | 0.004 |
| AD-18970 | 78 | 737 | 0.810 | NA | NA |
| AD-18971 | 79 | 738 | 0.336 | NA | NA |
| AD-18972 | 80 | 739 | 0.332 | NA | NA |
| AD-18973 | 81 | 740 | 0.707 | NA | NA |
| AD-18974 | 82 | 741 | 0.038 | NA | 0.007 |
| AD-18975 | 83 | 742 | 0.184 | 0.73 | NA |
| AD-18976 | 84 | 743 | 0.094 | NA | 0.118 |
| AD-18977 | 85 | 744 | 0.965 | NA | NA |
| AD-18978 | 86 | 745 | 0.848 | NA | NA |
| AD-18979 | 87 | 746 | 0.375 | NA | NA |
| AD-18980 | 88 | 747 | 0.052 | NA | NA |
| AD-18981 | 89 | 748 | 0.090 | NA | 0.004 |
| AD-18982 | 90 | 749 | 0.156 | NA | 0.156 |
| AD-18983 | 91 | 750 | 0.026 | 0.23 | 0.070 |
| AD-18984 | 92 | 751 | 0.913 | NA | NA |
| AD-18985 | 93 | 752 | 0.578 | NA | NA |
| AD-18986 | 94 | 753 | 0.073 | NA | 0.003 |
| AD-18987 | 95 | 754 | 0.626 | NA | NA |
| AD-18988 | 96 | 755 | 0.379 | NA | NA |
| AD-18989 | 97 | 756 | 0.879 | NA | NA |
| AD-18990 | 98 | 757 | 0.299 | NA | NA |
| AD-18991 | 99 | 758 | 0.112 | NA | 0.454 |
| AD-18992 | 100 | 759 | 1.171 | NA | NA |
| AD-18993 | 101 | 760 | 0.802 | NA | NA |
| AD-18994 | 102 | 761 | 0.071 | NA | 0.313 |
| AD-18995 | 103 | 762 | 0.096 | NA | 0.006 |
| AD-18996 | 104 | 763 | 0.450 | NA | NA |
| AD-18997 | 105 | 764 | 0.226 | NA | NA |
| AD-18998 | 106 | 765 | 0.279 | NA | NA |
| AD-18999 | 107 | 766 | 0.337 | NA | NA |
| AD-19000 | 108 | 767 | 0.134 | NA | 0.347 |
| AD-19001 | 109 | 768 | 0.470 | 0.71 | NA |
| AD-19002 | 110 | 769 | 0.619 | NA | NA |
| AD-19003 | 111 | 770 | 0.610 | NA | NA |
| AD-19004 | 112 | 771 | 0.066 | NA | 0.007 |
| AD-19005 | 113 | 772 | 0.274 | NA | NA |
| AD-19006 | 114 | 773 | 0.139 | NA | 0.994 |
| AD-19007 | 115 | 774 | 0.655 | NA | NA |
| AD-19008 | 116 | 775 | 0.088 | NA | 0.001 |
| AD-19009 | 117 | 776 | 0.066 | NA | 0.000 |
| AD-19010 | 118 | 111 | 0.227 | NA | NA |
| AD-19011 | 119 | 778 | 0.721 | NA | NA |
| AD-19012 | 120 | 779 | 0.175 | NA | 0.181 |
| AD-19042 | 121 | 780 | 0.283 | NA | NA |
| AD-19043 | 122 | 781 | 0.131 | NA | 0.006 |
| AD-19044 | 123 | 782 | 0.333 | NA | NA |
| AD-19045 | 124 | 783 | 0.553 | NA | NA |
| AD-19046 | 125 | 784 | 0.947 | NA | NA |
| AD-19047 | 126 | 785 | 0.774 | NA | NA |
| AD-19048 | 127 | 786 | 0.838 | NA | NA |
| AD-19049 | 128 | 787 | 0.938 | NA | NA |
| AD-19050 | 129 | 788 | 0.070 | NA | 0.001 |
| AD-19051 | 130 | 789 | 0.551 | NA | NA |
| AD-19052 | 131 | 790 | 0.818 | NA | NA |
| AD-19053 | 132 | 791 | 0.364 | NA | NA |
| AD-19054 | 133 | 792 | 0.075 | NA | 0.002 |
| AD-19055 | 134 | 793 | 0.210 | NA | NA |
| AD-19056 | 135 | 794 | 0.085 | NA | 0.019 |
| AD-19057 | 136 | 795 | 0.599 | NA | NA |
| AD-19058 | 137 | 796 | 0.577 | NA | NA |
| AD-19059 | 138 | 797 | 0.728 | NA | NA |
| AD-19060 | 139 | 798 | 1.072 | NA | NA |
| AD-19061 | 140 | 799 | 0.885 | NA | NA |
| AD-19062 | 141 | 800 | 0.810 | NA | NA |
| AD-19063 | 142 | 801 | 0.741 | NA | NA |
| AD-19064 | 143 | 802 | 0.591 | NA | NA |
| AD-19065 | 144 | 803 | 0.323 | NA | NA |
| AD-19066 | 145 | 804 | 0.086 | 0.48 | NA |
| AD-19067 | 146 | 805 | 0.138 | NA | NA |
| AD-19068 | 147 | 806 | 0.321 | NA | NA |
| AD-19069 | 148 | 807 | 0.135 | NA | 1.403 |
| AD-19070 | 149 | 808 | 0.892 | NA | NA |
| AD-19071 | 150 | 809 | 0.658 | NA | NA |
| AD-19072 | 151 | 810 | 0.704 | NA | NA |
| AD-19073 | 152 | 811 | 0.838 | NA | NA |
| AD-19074 | 153 | 812 | 0.042 | NA | 0.008 |
| AD-19075 | 154 | 813 | 0.841 | NA | NA |
| AD-19076 | 155 | 814 | 0.037 | NA | 0.002 |
| AD-19077 | 156 | 815 | 0.226 | NA | NA |

TABLE 5-continued

Analysis of RNAi agents to Beta-Catenin

| Duplex | Sense SEQ ID NO: | Anti-sense SEQ ID NO: | Residual Gene Activity 10 nM 24 hr | Residual Gene Activity 0.1 nM 120 hr | Avg. EC50 (nM) |
|---|---|---|---|---|---|
| AD-19078 | 157 | 816 | 0.719 | NA | NA |
| AD-19079 | 158 | 817 | 0.545 | NA | NA |
| AD-19080 | 159 | 818 | 0.092 | NA | 0.172 |
| AD-19081 | 160 | 819 | 0.203 | NA | 8.936 |
| AD-19082 | 161 | 820 | 0.055 | NA | 0.090 |
| AD-19083 | 162 | 821 | 0.404 | NA | NA |
| AD-19738 | 163 | 822 | 1.361 | NA | NA |
| AD-19739 | 164 | 823 | 0.970 | NA | NA |
| AD-19740 | 165 | 824 | 0.679 | NA | NA |
| AD-19741 | 166 | 825 | 0.168 | NA | NA |
| AD-19742 | 167 | 826 | 0.958 | NA | NA |
| AD-19743 | 168 | 827 | 0.839 | NA | NA |
| AD-19744 | 169 | 828 | 0.978 | NA | NA |
| AD-19745 | 170 | 829 | 0.852 | NA | NA |
| AD-19746 | 171 | 830 | 0.086 | NA | NA |
| AD-19747 | 172 | 831 | 0.187 | NA | NA |
| AD-19748 | 173 | 832 | 0.794 | NA | NA |
| AD-19749 | 174 | 833 | 0.115 | NA | NA |
| AD-19750 | 175 | 834 | 0.317 | NA | NA |
| AD-19751 | 176 | 835 | 0.591 | NA | NA |
| AD-19752 | 177 | 836 | 0.089 | NA | NA |
| AD-19753 | 178 | 837 | 0.091 | NA | NA |
| AD-19754 | 179 | 838 | 0.756 | NA | NA |
| AD-19755 | 180 | 839 | 0.443 | NA | NA |
| AD-19756 | 181 | 840 | 0.529 | NA | NA |
| AD-19757 | 182 | 841 | 0.265 | NA | NA |
| AD-19758 | 183 | 842 | 0.139 | NA | NA |
| AD-19759 | 184 | 843 | 0.465 | NA | NA |
| AD-19760 | 185 | 844 | 0.213 | NA | NA |
| AD-19761 | 186 | 845 | 1.234 | NA | NA |
| AD-19762 | 187 | 846 | 0.085 | NA | NA |
| AD-19763 | 188 | 847 | 0.593 | NA | NA |
| AD-19765 | 189 | 848 | 0.031 | NA | NA |
| AD-19766 | 190 | 849 | 0.469 | NA | NA |
| AD-19767 | 191 | 850 | 0.587 | NA | NA |
| AD-19768 | 192 | 851 | 0.780 | NA | NA |
| AD-20124 | 193 | 852 | 0.123 | 0.44 | NA |
| AD-25889 | 194 | 853 | 0.605 | 0.73 | NA |
| AD-25890 | 195 | 854 | 0.034 | 0.49 | 0.050 |
| AD-25891 | 196 | 855 | 0.041 | 0.16 | 0.050 |
| AD-25892 | 197 | 856 | 0.099 | 0.34 | NA |
| AD-25893 | 198 | 857 | 0.062 | 0.23 | 0.040 |
| AD-25894 | 199 | 858 | 0.033 | 0.13 | 0.004 |
| AD-25895 | 200 | 859 | 0.113 | 0.60 | NA |
| AD-25896 | 201 | 860 | 0.276 | 0.74 | NA |
| AD-25897 | 202 | 861 | 0.213 | 0.82 | NA |
| AD-25898 | 203 | 862 | 0.127 | 0.79 | NA |
| AD-25899 | 204 | 863 | 0.729 | 0.61 | NA |
| AD-25900 | 205 | 864 | 0.094 | 0.64 | NA |
| AD-25901 | 206 | 865 | 0.842 | 0.91 | NA |
| AD-25902 | 207 | 866 | 0.054 | 0.24 | NA |
| AD-25903 | 208 | 867 | 0.646 | 0.96 | NA |
| AD-25904 | 209 | 868 | 0.681 | 0.83 | NA |
| AD-25905 | 210 | 869 | 0.680 | 1.61 | NA |
| AD-25906 | 211 | 870 | 0.413 | 0.96 | NA |
| AD-25907 | 212 | 871 | 0.091 | 0.90 | NA |
| AD-25908 | 213 | 872 | 0.355 | 0.72 | NA |
| AD-25909 | 214 | 873 | 0.189 | 0.76 | NA |
| AD-25910 | 215 | 874 | 0.048 | 0.48 | 0.070 |
| AD-25911 | 216 | 875 | 0.134 | 0.81 | NA |
| AD-25912 | 217 | 876 | 0.095 | 0.66 | NA |
| AD-25913 | 218 | 877 | 0.291 | 0.94 | NA |
| AD-25914 | 219 | 878 | 0.057 | 0.47 | 0.054 |
| AD-25915 | 220 | 879 | 0.453 | 0.79 | NA |
| AD-25916 | 221 | 880 | 0.219 | 0.79 | NA |
| AD-25917 | 222 | 881 | 0.143 | 0.73 | NA |
| AD-25918 | 223 | 882 | 0.075 | 0.29 | 0.013 |
| AD-25919 | 224 | 883 | 0.123 | 0.68 | NA |
| AD-25920 | 225 | 884 | 0.255 | 0.69 | NA |
| AD-25921 | 226 | 885 | 0.637 | 0.81 | NA |
| AD-25922 | 227 | 886 | 0.283 | 0.83 | NA |
| AD-25923 | 228 | 887 | 0.575 | 0.64 | NA |
| AD-25924 | 229 | 888 | 0.118 | 0.52 | NA |
| AD-25925 | 230 | 889 | 0.242 | 0.96 | NA |
| AD-25926 | 231 | 890 | 0.150 | 0.67 | NA |
| AD-25927 | 232 | 891 | 0.394 | 0.72 | NA |
| AD-25928 | 233 | 892 | 0.138 | 0.62 | NA |
| AD-25929 | 234 | 893 | 0.073 | 0.50 | NA |
| AD-25930 | 235 | 894 | 0.095 | 0.71 | NA |
| AD-25931 | 236 | 895 | 0.076 | 0.77 | NA |
| AD-25932 | 237 | 896 | 0.073 | 0.61 | NA |
| AD-25933 | 238 | 897 | 0.113 | 0.79 | NA |
| AD-25934 | 239 | 898 | 0.223 | 0.46 | NA |
| AD-25935 | 240 | 899 | 0.288 | 0.78 | NA |
| AD-25936 | 241 | 900 | 0.413 | 0.78 | NA |
| AD-25937 | 242 | 901 | 0.838 | 0.77 | NA |
| AD-25938 | 243 | 902 | 0.038 | 0.08 | 0.006 |
| AD-25939 | 244 | 903 | 0.078 | 0.21 | NA |
| AD-25940 | 245 | 904 | 0.063 | 0.31 | NA |
| AD-25941 | 246 | 905 | 0.025 | 0.19 | 0.008 |
| AD-25942 | 247 | 906 | 0.029 | 0.20 | 0.016 |
| AD-25943 | 248 | 907 | 0.037 | 0.44 | 0.080 |
| AD-25944 | 249 | 908 | 0.038 | 0.23 | 0.007 |
| AD-25945 | 250 | 909 | 0.045 | 0.26 | NA |
| AD-25946 | 251 | 910 | 0.107 | 0.46 | NA |
| AD-25947 | 252 | 911 | 0.100 | 0.72 | NA |
| AD-25948 | 253 | 912 | 0.159 | 0.33 | NA |
| AD-25949 | 254 | 913 | 0.104 | 0.39 | NA |
| AD-25950 | 255 | 914 | 0.026 | 0.26 | 0.010 |
| AD-25951 | 256 | 915 | 0.026 | 0.28 | 0.007 |
| AD-25952 | 257 | 916 | 0.349 | 0.80 | NA |
| AD-25953 | 258 | 917 | 0.120 | 0.65 | NA |
| AD-25954 | 259 | 918 | 0.550 | 0.92 | NA |
| AD-25955 | 260 | 919 | 0.067 | 0.53 | NA |
| AD-25956 | 261 | 920 | 0.039 | 0.40 | 0.042 |
| AD-25957 | 262 | 921 | 0.105 | 0.64 | NA |
| AD-25958 | 263 | 922 | 0.044 | 0.38 | 0.024 |
| AD-25959 | 264 | 923 | 0.169 | 0.59 | NA |
| AD-25960 | 265 | 924 | 0.060 | 0.37 | 0.044 |
| AD-25961 | 266 | 925 | 0.162 | 0.67 | NA |
| AD-25962 | 267 | 926 | 0.684 | 0.76 | NA |
| AD-25963 | 268 | 927 | 0.106 | 0.48 | 0.275 |
| AD-25964 | 269 | 928 | 0.033 | 0.47 | 0.050 |
| AD-26017 | 270 | 929 | 0.113 | 0.87 | NA |
| AD-26018 | 271 | 930 | 0.060 | 0.37 | NA |
| AD-26019 | 272 | 931 | 0.106 | 0.42 | NA |
| AD-26020 | 273 | 932 | 0.043 | 0.50 | NA |
| AD-26021 | 274 | 933 | 0.046 | 0.69 | NA |
| AD-26022 | 275 | 934 | 0.109 | 0.83 | NA |
| AD-26023 | 276 | 935 | 0.637 | 0.80 | NA |
| AD-26024 | 277 | 936 | 0.226 | 0.73 | NA |
| AD-26025 | 278 | 937 | 0.252 | 0.96 | NA |
| AD-26026 | 279 | 938 | 0.088 | 0.58 | NA |
| AD-26027 | 280 | 939 | 0.228 | 0.96 | NA |
| AD-26028 | 281 | 940 | 0.025 | 0.28 | 0.050 |
| AD-26029 | 282 | 941 | 0.067 | 0.76 | NA |
| AD-26030 | 283 | 942 | 0.275 | 0.52 | NA |
| AD-26031 | 284 | 943 | 0.030 | 0.25 | 0.012 |
| AD-26032 | 285 | 944 | 0.078 | 0.50 | NA |
| AD-26033 | 286 | 945 | 0.353 | 0.69 | NA |
| AD-26034 | 287 | 946 | 0.022 | 0.16 | 0.009 |
| AD-26035 | 288 | 947 | 0.106 | 0.36 | NA |
| AD-26036 | 289 | 948 | 0.336 | 0.63 | NA |
| AD-26037 | 290 | 949 | 0.136 | 0.45 | NA |
| AD-26038 | 291 | 950 | 0.215 | 0.46 | NA |
| AD-26039 | 292 | 951 | 0.591 | 0.69 | NA |
| AD-26040 | 293 | 952 | 0.046 | 0.15 | 0.099 |
| AD-26041 | 294 | 953 | 0.324 | 0.67 | NA |
| AD-26042 | 295 | 954 | 0.026 | 0.38 | 0.010 |
| AD-26043 | 296 | 955 | 0.026 | 0.09 | 0.075 |
| AD-26044 | 297 | 956 | 0.034 | 0.37 | NA |
| AD-26045 | 298 | 957 | 0.531 | 0.77 | NA |
| AD-26046 | 299 | 958 | 0.531 | 0.58 | NA |
| AD-26047 | 300 | 959 | 0.023 | 0.47 | 0.058 |
| AD-26048 | 301 | 960 | 0.397 | 0.95 | NA |
| AD-26049 | 302 | 961 | 0.212 | 0.65 | NA |
| AD-26050 | 303 | 962 | 0.204 | 0.95 | NA |
| AD-26051 | 304 | 963 | 0.619 | 0.57 | NA |

TABLE 5-continued

Analysis of RNAi agents to Beta-Catenin

| Duplex | Sense SEQ ID NO: | Anti-sense SEQ ID NO: | Residual Gene Activity 10 nM 24 hr | Residual Gene Activity 0.1 nM 120 hr | Avg. EC50 (nM) |
|---|---|---|---|---|---|
| AD-26052 | 305 | 964 | 0.037 | 0.55 | NA |
| AD-26053 | 306 | 965 | 0.369 | 0.71 | NA |
| AD-26054 | 307 | 966 | 0.616 | 0.78 | NA |
| AD-26055 | 308 | 967 | 0.424 | 0.64 | NA |
| AD-26056 | 309 | 968 | 0.168 | 0.81 | NA |
| AD-26057 | 310 | 969 | 0.086 | 0.28 | NA |
| AD-26058 | 311 | 970 | 0.456 | 0.67 | NA |
| AD-26059 | 312 | 971 | 0.169 | 0.47 | NA |
| AD-26060 | 313 | 972 | 0.057 | 0.19 | 0.139 |
| AD-26061 | 314 | 973 | 0.050 | 0.42 | NA |
| AD-26062 | 315 | 974 | 0.110 | 0.64 | NA |
| AD-26063 | 316 | 975 | 0.021 | 0.74 | NA |
| AD-26064 | 317 | 976 | 0.785 | 0.62 | NA |
| AD-26065 | 318 | 977 | 0.678 | 0.84 | NA |
| AD-26066 | 319 | 978 | 0.035 | 0.44 | NA |
| AD-26067 | 320 | 979 | 0.305 | 0.51 | NA |
| AD-26068 | 321 | 980 | 0.028 | 0.50 | 0.102 |
| AD-26069 | 322 | 981 | 0.046 | 0.50 | NA |
| AD-26070 | 323 | 982 | 0.446 | 0.64 | NA |
| AD-26071 | 324 | 983 | 0.074 | 0.48 | NA |
| AD-26072 | 325 | 984 | 0.742 | 0.84 | NA |
| AD-26073 | 326 | 985 | 0.086 | 0.33 | NA |
| AD-26074 | 327 | 986 | 0.227 | 0.55 | NA |
| AD-26075 | 328 | 987 | 0.092 | 0.74 | NA |
| AD-26076 | 329 | 988 | 0.029 | 0.24 | 0.159 |
| AD-26077 | 330 | 989 | 0.191 | 0.70 | NA |
| AD-26078 | 331 | 990 | 0.032 | 0.32 | 0.106 |
| AD-26079 | 332 | 991 | 0.131 | 0.55 | NA |
| AD-26080 | 333 | 992 | 0.589 | 0.86 | NA |
| AD-26081 | 334 | 993 | 0.538 | 0.66 | NA |
| AD-26082 | 335 | 994 | 0.021 | 0.42 | 0.039 |
| AD-26083 | 336 | 995 | 0.049 | 0.25 | NA |
| AD-26084 | 337 | 996 | 0.334 | 0.75 | NA |
| AD-26085 | 338 | 997 | 0.192 | 0.69 | NA |
| AD-26086 | 339 | 998 | 0.524 | 0.62 | NA |
| AD-26087 | 340 | 999 | 0.276 | 0.71 | NA |
| AD-26088 | 341 | 1000 | 0.101 | 0.83 | NA |
| AD-26089 | 342 | 1001 | 0.821 | 0.93 | NA |
| AD-26090 | 343 | 1002 | 0.367 | 0.77 | NA |
| AD-26091 | 344 | 1003 | 0.022 | 0.32 | 0.057 |
| AD-26092 | 345 | 1004 | 0.246 | 0.75 | NA |
| AD-26093 | 346 | 1005 | 0.570 | 0.70 | NA |
| AD-26094 | 347 | 1006 | 0.145 | 0.57 | NA |
| AD-26095 | 348 | 1007 | 0.073 | 0.58 | NA |
| AD-26096 | 349 | 1008 | 0.109 | 0.51 | NA |
| AD-26097 | 350 | 1009 | 0.145 | 0.57 | NA |
| AD-26098 | 351 | 1010 | 0.101 | 0.43 | NA |
| AD-26099 | 352 | 1011 | 0.171 | 0.68 | NA |
| AD-26100 | 353 | 1012 | 0.058 | 0.21 | NA |
| AD-26101 | 354 | 1013 | 0.041 | 0.30 | 0.030 |
| AD-26102 | 355 | 1014 | 0.169 | 0.93 | NA |
| AD-26103 | 356 | 1015 | 0.209 | 0.61 | NA |
| AD-26104 | 357 | 1016 | 0.016 | 0.22 | 0.058 |
| AD-26105 | 358 | 1017 | 0.044 | 0.49 | NA |
| AD-26106 | 359 | 1018 | 0.169 | 0.75 | NA |
| AD-26107 | 360 | 1019 | 0.290 | 0.90 | NA |
| AD-26108 | 361 | 1020 | 0.040 | 0.50 | 0.030 |
| AD-26109 | 362 | 1021 | 0.024 | 0.22 | 0.025 |
| AD-26110 | 363 | 1022 | 0.326 | 0.79 | NA |
| AD-26111 | 364 | 1023 | 0.798 | 0.77 | NA |
| AD-26112 | 365 | 1024 | 0.301 | 0.51 | NA |
| AD-26123 | 366 | 1025 | 0.652 | 0.84 | NA |
| AD-26124 | 367 | 1026 | 0.277 | 0.48 | NA |
| AD-26125 | 368 | 1027 | 0.342 | 0.64 | NA |
| AD-26126 | 369 | 1028 | 0.094 | 0.46 | NA |
| AD-26127 | 370 | 1029 | 0.455 | 0.80 | NA |
| AD-26128 | 371 | 1030 | 0.058 | 0.24 | 0.066 |
| AD-26129 | 372 | 1031 | 0.409 | 0.57 | NA |
| AD-26130 | 373 | 1032 | 0.892 | 0.80 | NA |
| AD-26131 | 374 | 1033 | 0.067 | 0.41 | 0.104 |
| AD-26132 | 375 | 1034 | 0.109 | 0.19 | 0.060 |
| AD-26133 | 376 | 1035 | 0.790 | 0.85 | NA |
| AD-26134 | 377 | 1036 | 0.046 | 0.27 | 0.103 |
| AD-26135 | 378 | 1037 | 0.069 | 0.38 | NA |
| AD-26136 | 379 | 1038 | 0.451 | 0.78 | NA |
| AD-26137 | 380 | 1039 | 0.685 | 0.64 | NA |
| AD-26138 | 381 | 1040 | 0.579 | 0.63 | NA |
| AD-26139 | 382 | 1041 | 0.857 | 0.59 | NA |
| AD-26140 | 383 | 1042 | 0.384 | 0.71 | NA |
| AD-26141 | 384 | 1043 | 0.104 | 0.49 | NA |
| AD-26142 | 385 | 1044 | 0.199 | 0.59 | NA |
| AD-26143 | 386 | 1045 | 0.205 | 0.61 | NA |
| AD-26144 | 387 | 1046 | 0.821 | 1.04 | NA |
| AD-26145 | 388 | 1047 | 0.860 | 0.86 | NA |
| AD-26146 | 389 | 1048 | 0.076 | 0.34 | NA |
| AD-26147 | 390 | 1049 | 0.559 | 0.65 | NA |
| AD-26148 | 391 | 1050 | 0.066 | 0.48 | NA |
| AD-26149 | 392 | 1051 | 0.326 | 0.50 | NA |
| AD-26150 | 393 | 1052 | 0.396 | 0.66 | NA |
| AD-26151 | 394 | 1053 | 0.249 | 0.54 | NA |
| AD-26152 | 395 | 1054 | 0.837 | 0.74 | NA |
| AD-26153 | 396 | 1055 | 0.119 | 0.39 | NA |
| AD-26154 | 397 | 1056 | 0.600 | 0.64 | NA |
| AD-26155 | 398 | 1057 | 0.693 | 0.69 | NA |
| AD-26156 | 399 | 1058 | 0.033 | 0.35 | 0.020 |
| AD-26157 | 400 | 1059 | 0.220 | 0.74 | NA |
| AD-26158 | 401 | 1060 | 0.031 | 0.40 | 0.033 |
| AD-26159 | 402 | 1061 | 0.387 | 0.49 | NA |
| AD-26160 | 403 | 1062 | 0.836 | 0.73 | NA |
| AD-26161 | 404 | 1063 | 0.831 | 0.76 | NA |
| AD-26162 | 405 | 1064 | 0.358 | 0.50 | NA |
| AD-26163 | 406 | 1065 | 0.817 | 0.66 | NA |
| AD-26164 | 407 | 1066 | 0.112 | 0.59 | NA |
| AD-26165 | 408 | 1067 | 0.272 | 0.67 | NA |
| AD-26166 | 409 | 1068 | 0.300 | 0.63 | NA |
| AD-26167 | 410 | 1069 | 0.664 | 0.77 | NA |
| AD-26168 | 411 | 1070 | 0.771 | 0.78 | NA |
| AD-26169 | 412 | 1071 | 0.480 | 0.67 | NA |
| AD-26170 | 413 | 1072 | 0.174 | 0.47 | NA |
| AD-26171 | 414 | 1073 | 0.410 | 0.75 | NA |
| AD-26172 | 415 | 1074 | 0.294 | 0.74 | NA |
| AD-26173 | 416 | 1075 | 0.384 | 0.71 | NA |
| AD-26174 | 417 | 1076 | 0.388 | 0.79 | NA |
| AD-26175 | 418 | 1077 | 0.611 | 0.72 | NA |
| AD-26176 | 419 | 1078 | 0.055 | 0.44 | NA |
| AD-26177 | 420 | 1079 | 0.310 | 0.67 | NA |
| AD-26178 | 421 | 1080 | 0.038 | 0.20 | 0.094 |
| AD-26179 | 422 | 1081 | 0.042 | 0.33 | 0.108 |
| AD-26180 | 423 | 1082 | 0.031 | 0.21 | 0.036 |
| AD-26181 | 424 | 1083 | 0.041 | 0.08 | 0.034 |
| AD-26182 | 425 | 1084 | 0.237 | 0.79 | NA |
| AD-26183 | 426 | 1085 | 0.028 | 0.37 | 0.070 |
| AD-26184 | 427 | 1086 | 0.189 | 0.54 | NA |
| AD-26185 | 428 | 1087 | 0.357 | 0.76 | NA |
| AD-26186 | 6495 | 1088 | 0.066 | 0.60 | NA |
| AD-26187 | 6496 | 1089 | 0.298 | 0.60 | NA |
| AD-26188 | 431 | 1090 | 0.159 | 0.51 | NA |
| AD-26189 | 432 | 1091 | 0.143 | 0.51 | NA |
| AD-26190 | 433 | 1092 | 0.063 | 0.34 | NA |
| AD-26191 | 434 | 1093 | 0.674 | 0.82 | NA |
| AD-26192 | 435 | 1094 | 0.446 | 0.75 | NA |
| AD-26193 | 436 | 1095 | 0.058 | 0.36 | 0.055 |
| AD-26194 | 437 | 1096 | 0.289 | 0.84 | NA |
| AD-26195 | 438 | 1097 | 0.353 | 0.81 | NA |
| AD-26196 | 439 | 1098 | 0.055 | 0.35 | NA |
| AD-26197 | 440 | 1099 | 0.440 | 0.68 | NA |
| AD-26198 | 441 | 1100 | 0.175 | 0.53 | NA |
| AD-26199 | 442 | 1101 | 0.055 | 0.58 | NA |
| AD-26200 | 443 | 1102 | 0.076 | 0.46 | NA |
| AD-26201 | 444 | 1103 | 0.283 | 0.48 | NA |
| AD-26202 | 445 | 1104 | 0.052 | 0.70 | NA |
| AD-26203 | 446 | 1105 | 0.045 | 0.22 | 0.162 |
| AD-26204 | 447 | 1106 | 0.660 | 0.73 | NA |
| AD-26205 | 448 | 1107 | 0.324 | 0.76 | NA |
| AD-26206 | 449 | 1108 | 0.520 | 1.12 | NA |
| AD-26207 | 450 | 1109 | 0.367 | 0.75 | NA |
| AD-26208 | 451 | 1110 | 0.795 | 0.73 | NA |
| AD-26209 | 452 | 1111 | 0.112 | 0.54 | NA |

TABLE 5-continued

Analysis of RNAi agents to Beta-Catenin

| Duplex | Sense SEQ ID NO: | Anti-sense SEQ ID NO: | Residual Gene Activity 10 nM 24 hr | Residual Gene Activity 0.1 nM 120 hr | Avg. EC50 (nM) |
|---|---|---|---|---|---|
| AD-26210 | 453 | 1112 | 0.030 | 0.39 | NA |
| AD-26211 | 454 | 1113 | 0.124 | 0.25 | NA |
| AD-26212 | 455 | 1114 | 0.151 | 0.45 | NA |
| AD-26213 | 456 | 1115 | 0.223 | 0.63 | NA |
| AD-26214 | 457 | 1116 | 0.513 | 0.66 | NA |
| AD-26215 | 458 | 1117 | 0.102 | 0.29 | NA |
| AD-26216 | 459 | 1118 | 0.496 | 0.58 | NA |
| AD-26217 | 460 | 1119 | 0.410 | 0.77 | NA |
| AD-26218 | 461 | 1120 | 0.041 | 0.15 | 0.026 |
| AD-26651 | 462 | 1121 | 0.023 | 0.21 | 0.041 |
| AD-26652 | 463 | 1122 | 0.025 | 0.21 | 0.026 |
| AD-26653 | 464 | 1123 | 0.115 | 0.76 | NA |
| AD-26654 | 465 | 1124 | 0.068 | 0.88 | NA |
| AD-26655 | 466 | 1125 | 0.682 | 0.86 | NA |
| AD-26656 | 467 | 1126 | 0.684 | 0.91 | NA |
| AD-26657 | 468 | 1127 | 0.468 | 0.89 | NA |
| AD-26658 | 469 | 1128 | 0.305 | 0.50 | NA |
| AD-26659 | 470 | 1129 | 0.481 | 0.50 | NA |
| AD-26660 | 471 | 1130 | 0.041 | 0.20 | 0.010 |
| AD-26661 | 472 | 1131 | 0.194 | 0.77 | NA |
| AD-26662 | 473 | 1132 | 0.717 | 1.00 | NA |
| AD-26663 | 474 | 1133 | 0.546 | 1.02 | NA |
| AD-26664 | 475 | 1134 | 0.030 | 0.36 | NA |
| AD-26665 | 476 | 1135 | 0.037 | 0.25 | 0.008 |
| AD-26666 | 477 | 1136 | 0.072 | 0.57 | NA |
| AD-26667 | 478 | 1137 | 0.587 | 0.65 | NA |
| AD-26668 | 479 | 1138 | 0.760 | 0.70 | NA |
| AD-26669 | 480 | 1139 | 0.038 | 0.64 | NA |
| AD-26670 | 481 | 1140 | 0.033 | 0.32 | 0.005 |
| AD-26671 | 482 | 1141 | 0.091 | 0.71 | NA |
| AD-26672 | 483 | 1142 | 0.084 | 0.56 | NA |
| AD-26673 | 484 | 1143 | 0.027 | 0.18 | 0.012 |
| AD-26674 | 485 | 1144 | 0.044 | 0.32 | 0.021 |
| AD-26675 | 486 | 1145 | 0.063 | 0.67 | NA |
| AD-26676 | 487 | 1146 | 0.617 | 0.81 | NA |
| AD-26677 | 488 | 1147 | 0.138 | 0.50 | NA |
| AD-26678 | 489 | 1148 | 0.055 | 0.34 | NA |
| AD-26679 | 490 | 1149 | 0.052 | 0.44 | NA |
| AD-26680 | 491 | 1150 | 0.191 | 0.42 | NA |
| AD-26681 | 492 | 1151 | 0.092 | 0.57 | NA |
| AD-26682 | 493 | 1152 | 0.035 | 0.11 | 0.007 |
| AD-26683 | 494 | 1153 | 0.055 | 0.87 | NA |
| AD-26684 | 495 | 1154 | 0.035 | 0.16 | 0.009 |
| AD-26685 | 496 | 1155 | 0.034 | 0.37 | NA |
| AD-26686 | 497 | 1156 | 0.821 | 0.77 | NA |
| AD-26687 | 498 | 1157 | 0.151 | 0.29 | NA |
| AD-26688 | 499 | 1158 | 0.094 | 0.69 | NA |
| AD-26689 | 500 | 1159 | 0.086 | 0.61 | NA |
| AD-26690 | 501 | 1160 | 0.047 | 0.36 | NA |
| AD-26691 | 502 | 1161 | 0.030 | 0.24 | 0.020 |
| AD-26692 | 503 | 1162 | 0.222 | 0.62 | NA |
| AD-26693 | 504 | 1163 | 0.739 | 0.76 | NA |
| AD-26694 | 505 | 1164 | 0.331 | 0.63 | NA |
| AD-26695 | 506 | 1165 | 0.371 | 0.66 | NA |
| AD-26696 | 507 | 1166 | 0.023 | 0.37 | 0.027 |
| AD-26697 | 508 | 1167 | 1.024 | 0.80 | NA |
| AD-26698 | 509 | 1168 | 0.047 | 0.22 | NA |
| AD-26699 | 510 | 1169 | 0.145 | 0.71 | NA |
| AD-26700 | 511 | 1170 | 0.028 | 0.08 | 0.005 |
| AD-26701 | 512 | 1171 | 0.028 | 0.21 | 0.006 |
| AD-26702 | 513 | 1172 | 0.046 | 0.43 | NA |
| AD-26703 | 514 | 1173 | 0.193 | 0.65 | NA |
| AD-26704 | 515 | 1174 | 0.027 | 0.36 | 0.010 |
| AD-26705 | 516 | 1175 | 0.054 | 0.40 | NA |
| AD-26706 | 517 | 1176 | 0.223 | 0.52 | NA |
| AD-26707 | 518 | 1177 | 0.144 | 0.70 | NA |
| AD-26708 | 519 | 1178 | 0.160 | 0.59 | NA |
| AD-26709 | 520 | 1179 | 0.818 | 0.80 | NA |
| AD-26710 | 521 | 1180 | 0.307 | 0.84 | NA |
| AD-26711 | 522 | 1181 | 0.209 | 0.46 | NA |
| AD-26712 | 523 | 1182 | 0.276 | 0.76 | NA |
| AD-26713 | 524 | 1183 | 0.043 | 0.23 | 0.014 |
| AD-26714 | 525 | 1184 | 0.108 | 0.65 | NA |
| AD-26715 | 526 | 1185 | 0.777 | 0.67 | NA |
| AD-26716 | 527 | 1186 | 0.551 | 0.69 | NA |
| AD-26717 | 528 | 1187 | 0.643 | 0.80 | NA |
| AD-26718 | 529 | 1188 | 0.821 | 0.70 | NA |
| AD-26719 | 530 | 1189 | 0.053 | 0.35 | NA |
| AD-26720 | 531 | 1190 | 0.148 | 0.62 | NA |
| AD-26721 | 532 | 1191 | 0.906 | 0.92 | NA |
| AD-26722 | 533 | 1192 | 0.042 | 0.38 | 0.033 |
| AD-26723 | 534 | 1193 | 0.136 | 0.69 | NA |
| AD-26724 | 535 | 1194 | 0.472 | 1.00 | NA |
| AD-26725 | 536 | 1195 | 0.082 | 0.39 | NA |
| AD-26726 | 537 | 1196 | 0.258 | 0.70 | NA |
| AD-26727 | 538 | 1197 | 0.043 | 0.33 | NA |
| AD-26728 | 539 | 1198 | 0.612 | 0.80 | NA |
| AD-26729 | 540 | 1199 | 0.056 | 0.15 | 0.007 |
| AD-26730 | 541 | 1200 | 0.038 | 0.13 | 0.007 |
| AD-26731 | 542 | 1201 | 0.034 | 0.10 | 0.035 |
| AD-26732 | 543 | 1202 | 0.853 | 0.74 | NA |
| AD-26733 | 544 | 1203 | 0.805 | 0.77 | NA |
| AD-26734 | 545 | 1204 | 0.580 | 0.77 | NA |
| AD-26735 | 546 | 1205 | 0.457 | 1.02 | NA |
| AD-26736 | 547 | 1206 | 0.701 | 0.75 | NA |
| AD-26737 | 548 | 1207 | 0.066 | 0.33 | NA |
| AD-26738 | 549 | 1208 | 0.327 | 0.79 | NA |
| AD-26739 | 550 | 1209 | 0.102 | 0.44 | NA |
| AD-26740 | 551 | 1210 | 0.030 | 0.08 | 0.006 |
| AD-26741 | 552 | 1211 | 0.128 | 0.50 | NA |
| AD-26742 | 553 | 1212 | 0.025 | 0.34 | 0.057 |
| AD-26743 | 554 | 1213 | 0.033 | 0.38 | 0.061 |
| AD-26744 | 555 | 1214 | 0.170 | 0.74 | NA |
| AD-26745 | 556 | 1215 | 0.304 | 0.55 | NA |
| AD-26746 | 557 | 1216 | 0.037 | 0.33 | NA |
| AD-26747 | 558 | 1217 | 0.048 | 0.43 | NA |
| AD-26748 | 559 | 1218 | 0.081 | 0.51 | NA |
| AD-26749 | 560 | 1219 | 0.184 | 0.70 | NA |
| AD-26750 | 561 | 1220 | 0.209 | 0.64 | NA |
| AD-26751 | 562 | 1221 | 0.570 | 0.71 | NA |
| AD-26752 | 563 | 1222 | 0.040 | 0.45 | 0.042 |
| AD-26753 | 564 | 1223 | 0.153 | 0.61 | NA |
| AD-26754 | 565 | 1224 | 0.518 | 0.79 | NA |
| AD-26755 | 566 | 1225 | 0.064 | 0.27 | NA |
| AD-26756 | 567 | 1226 | 0.146 | 0.48 | NA |
| AD-26757 | 568 | 1227 | 0.035 | 0.22 | 0.047 |
| AD-26758 | 569 | 1228 | 0.053 | 0.46 | NA |
| AD-26759 | 570 | 1229 | 0.116 | 0.59 | NA |
| AD-26760 | 571 | 1230 | 0.435 | 0.60 | NA |
| AD-26761 | 572 | 1231 | 0.088 | 0.44 | NA |
| AD-26762 | 573 | 1232 | 0.385 | 0.57 | NA |
| AD-26763 | 574 | 1233 | 0.057 | 0.22 | 0.015 |
| AD-26764 | 575 | 1234 | 0.120 | 0.47 | NA |
| AD-26765 | 576 | 1235 | 0.058 | 0.43 | NA |
| AD-26766 | 577 | 1236 | 0.183 | 0.72 | NA |
| AD-26767 | 578 | 1237 | 0.582 | 0.57 | NA |
| AD-26768 | 579 | 1238 | 0.042 | 0.39 | NA |
| AD-26769 | 580 | 1239 | 0.071 | 0.52 | NA |
| AD-26770 | 581 | 1240 | 0.398 | 0.58 | NA |
| AD-26771 | 582 | 1241 | 0.576 | 0.71 | NA |
| AD-26772 | 583 | 1242 | 0.784 | 0.64 | NA |
| AD-26773 | 584 | 1243 | 0.353 | 0.58 | NA |
| AD-26774 | 585 | 1244 | 0.069 | 0.55 | NA |
| AD-26775 | 586 | 1245 | 0.506 | 0.86 | NA |
| AD-26776 | 587 | 1246 | 0.079 | 0.26 | NA |
| AD-26777 | 588 | 1247 | 0.363 | 0.73 | NA |
| AD-26778 | 589 | 1248 | 0.101 | 0.40 | NA |
| AD-26779 | 590 | 1249 | 0.040 | 0.34 | 0.109 |
| AD-26780 | 591 | 1250 | 0.069 | 0.25 | NA |
| AD-26781 | 592 | 1251 | 0.044 | 0.24 | NA |
| AD-26782 | 593 | 1252 | 0.054 | 0.53 | NA |
| AD-26783 | 594 | 1253 | 0.053 | 0.51 | NA |
| AD-26784 | 595 | 1254 | 0.072 | 0.53 | NA |
| AD-26785 | 596 | 1255 | 0.201 | 0.51 | NA |
| AD-26786 | 597 | 1256 | 0.134 | 0.81 | NA |
| AD-26787 | 598 | 1257 | 0.143 | 0.60 | NA |
| AD-26788 | 599 | 1258 | 0.036 | 0.57 | 0.053 |
| AD-26789 | 600 | 1259 | 0.418 | 0.74 | NA |

TABLE 5-continued

Analysis of RNAi agents to Beta-Catenin

| Duplex | Sense SEQ ID NO: | Anti-sense SEQ ID NO: | Residual Gene Activity 10 nM 24 hr | Residual Gene Activity 0.1 nM 120 hr | Avg. EC50 (nM) |
|---|---|---|---|---|---|
| AD-26790 | 601 | 1260 | 0.122 | 0.62 | NA |
| AD-26791 | 602 | 1261 | 0.305 | 0.73 | NA |
| AD-26792 | 603 | 1262 | 0.346 | 0.76 | NA |
| AD-26793 | 604 | 1263 | 0.391 | 0.63 | NA |
| AD-26794 | 605 | 1264 | 0.077 | 0.40 | NA |
| AD-26795 | 606 | 1265 | 0.586 | 0.65 | NA |
| AD-26796 | 607 | 1266 | 0.392 | 0.70 | NA |
| AD-26797 | 608 | 1267 | 0.063 | 0.73 | NA |
| AD-26798 | 609 | 1268 | 0.249 | 0.62 | NA |
| AD-26799 | 610 | 1269 | 0.345 | 0.66 | NA |
| AD-26800 | 611 | 1270 | 0.034 | 0.20 | 0.025 |
| AD-26801 | 612 | 1271 | 0.044 | 0.46 | NA |
| AD-26802 | 613 | 1272 | 0.096 | 0.57 | NA |
| AD-26803 | 614 | 1273 | 0.162 | 0.57 | NA |
| AD-26804 | 615 | 1274 | 0.056 | 0.35 | NA |
| AD-26805 | 616 | 1275 | 0.742 | 0.66 | NA |
| AD-26806 | 617 | 1276 | 0.080 | 0.69 | NA |
| AD-26807 | 618 | 1277 | 0.517 | 0.62 | NA |
| AD-26808 | 619 | 1278 | 0.043 | 0.51 | NA |
| AD-26809 | 620 | 1279 | 0.227 | 0.61 | NA |
| AD-26810 | 621 | 1280 | 0.048 | 0.22 | 0.039 |
| AD-26811 | 622 | 1281 | 0.333 | 0.85 | NA |
| AD-26812 | 623 | 1282 | 0.522 | 0.84 | NA |
| AD-26813 | 624 | 1283 | 0.044 | 0.33 | 0.076 |
| AD-26814 | 625 | 1284 | 0.545 | 0.72 | NA |
| AD-26815 | 626 | 1285 | 0.594 | 0.63 | NA |
| AD-26816 | 627 | 1286 | 0.044 | 0.37 | NA |
| AD-26817 | 628 | 1287 | 0.523 | 0.68 | NA |
| AD-26818 | 629 | 1288 | 0.575 | 1.80 | NA |
| AD-26819 | 630 | 1289 | 0.069 | 0.41 | NA |
| AD-26820 | 631 | 1290 | 0.484 | 0.76 | NA |
| AD-26821 | 632 | 1291 | 0.245 | 0.70 | NA |
| AD-26822 | 633 | 1292 | 0.039 | 0.23 | 0.037 |
| AD-26823 | 634 | 1293 | 0.062 | 0.09 | 0.033 |
| AD-26824 | 635 | 1294 | 0.304 | 0.60 | NA |
| AD-26825 | 636 | 1295 | 0.038 | 0.36 | NA |
| AD-26826 | 637 | 1296 | 0.105 | 0.57 | NA |
| AD-26900 | 638 | 1297 | 0.056 | 0.73 | 0.033 |
| AD-26901 | 639 | 1298 | 0.065 | 0.68 | NA |
| AD-26902 | 640 | 1299 | 0.053 | 0.42 | NA |
| AD-26903 | 641 | 1300 | 0.075 | 0.59 | NA |
| AD-26904 | 642 | 1301 | 0.051 | 0.38 | NA |
| AD-26905 | 643 | 1302 | 0.084 | 0.45 | NA |
| AD-26906 | 644 | 1303 | 0.186 | 0.76 | NA |
| AD-26907 | 645 | 1304 | 0.610 | 0.82 | NA |
| AD-26908 | 646 | 1305 | 0.073 | 0.78 | NA |
| AD-26909 | 647 | 1306 | 0.235 | 0.99 | NA |
| AD-26910 | 648 | 1307 | 0.077 | 0.78 | NA |
| AD-26911 | 649 | 1308 | 0.193 | 0.96 | NA |
| AD-26912 | 650 | 1309 | 0.074 | 0.73 | NA |
| AD-26913 | 651 | 1310 | 0.141 | 0.88 | NA |
| AD-26914 | 652 | 1311 | 0.519 | 0.64 | NA |
| AD-26915 | 653 | 1312 | 0.587 | 0.71 | NA |
| AD-26916 | 654 | 1313 | 0.063 | 0.62 | NA |
| AD-26917 | 655 | 1314 | 0.076 | 0.55 | NA |
| AD-26918 | 656 | 1315 | 0.069 | 0.28 | 0.029 |
| AD-26919 | 657 | 1316 | 0.085 | 0.55 | NA |
| AD-26920 | 658 | 1317 | 0.042 | 0.31 | NA |
| AD-26921 | 659 | 1318 | 0.025 | 0.09 | 0.014 |

NA: data not available or not determined.

"Fold-Change" represents the residual level (in HeLa cells) at a particular time and concentration, relative to control. Thus, a "Fold-Change 10 nM 24 hr" for AD-18892 of "0.054" indicates that, at a concentration of 10 nM, there was 5.4% residual Beta-Catenin level, or 94.6% gene knock-down, in HeLa cells at 24 hr after treating the cells with the RNAi agent.

"Fold-Change 0.1 nM 120 hr" indicates the residual Beta-Catenin level at a concentration of 0.1 nM, measured at 120 hr.

"Avg. EC50 (nM)" indicates a concentration estimated, based on available data, to allow 50% gene knock-down in HeLa cells. Thus, for AD-18893, a concentration of 0.008 nM is estimated to knock down Beta-Catenin by 50%. To calculate estimated average EC50 figures, HeLa cells were treated with RNAi agents at concentrations of 10 nM, 1 nM, 0.1 nM, 0.01 nM, and 0.001 nM of RNAi agent, and the data fit to a curve. The indicated EC50 is an estimated EC50 calculated from available data that is expected to give 50% gene knock-down of Beta-Catenin in HeLa cells.

Tables 1 to 8 thus disclose various RNAi agents capable of mediating gene knock-down of Beta-Catenin.

TABLE 6

Analysis of RNAi agents to Beta-Catenin
Additional duplexes targeting Beta-Catenin (listed in Table 3) were tested in vitro against HeLa cells. 48 hour results were measured; duplex concentration was 6 nM, 3 nM and 1.5 nM. Data in this table represents residual gene activity; thus Set1 254 A22 S26 showed 4.9% residual gene activity (e.g., 95.1% gene knockdown) at 48 hours at 6 nM in HeLa cells.

| Nickname | AV HeLa set1-2 d3-6 nM | AV HeLa set1-2 3 nM | AV HeLa set1-2 1.5 nM | SD HeLa set1-2 d3-6 nM | SD HeLa set1-2 3 nM | SD HeLa set1-2 1.5 nM |
|---|---|---|---|---|---|---|
| Set1 254 A22 S26 | 4.9 | 11.1 | 22.5 | 1.6 | 2.1 | 1.6 |
| Set1 703 A22 S26 | 4.8 | 12.4 | 29.0 | 1.5 | 2.4 | 7.3 |
| Set1 709 A22 S26 | 6.5 | 13.9 | 30.7 | 1.1 | 2.0 | 7.1 |
| Set1 895 A22 S26 | 5.9 | 13.1 | 48.0 | 0.8 | 3.9 | 25.6 |
| Set1 1816 A22 S26 | 4.9 | 12.3 | 28.6 | 0.5 | 2.8 | 4.3 |
| Set1 1974 A22 S26 | 6.6 | 12.5 | 36.9 | 1.0 | 0.9 | 0.6 |
| Set1 2425 A22 S26 | 5.6 | 13.6 | 27.3 | 0.4 | 1.7 | 9.7 |
| Set1 3146 A22 S26 | 4.5 | 9.3 | 21.0 | 1.1 | 1.2 | 2.9 |
| Set1 889 A22 S26 | 8.6 | 14.2 | 37.9 | 3.4 | 3.7 | 17.1 |
| Set1 1814 A22 S26 | 6.0 | 11.8 | 21.3 | 2.2 | 3.8 | 4.6 |
| Set1 1245 A22 S26 | 6.7 | 12.0 | 28.2 | 2.6 | 2.5 | 8.7 |
| Set1 3196 A22 S26 | 4.5 | 9.1 | 17.1 | 0.5 | 0.0 | 5.3 |
| Set1 1450 A22 S26 | 4.4 | 12.5 | 25.4 | 0.3 | 3.6 | 2.7 |
| Set1 3169 A22 S26 | 6.3 | 13.1 | 29.7 | 0.9 | 2.2 | 9.8 |

TABLE 6-continued

Analysis of RNAi agents to Beta-Catenin
Additional duplexes targeting Beta-Catenin (listed in Table 3) were tested in vitro against
HeLa cells. 48 hour results were measured; duplex concentration was 6 nM, 3 nM and 1.5 nM.
Data in this table represents residual gene activity; thus Set1 254 A22 S26 showed 4.9%
residual gene activity (e.g., 95.1% gene knockdown) at 48 hours at 6 nM in HeLa cells.

| Nickname | AV HeLa set1-2 d3-6 nM | AV HeLa set1-2 3 nM | AV HeLa set1-2 1.5 nM | SD HeLa set1-2 d3-6 nM | SD HeLa set1-2 3 nM | SD HeLa set1-2 1.5 nM |
|---|---|---|---|---|---|---|
| Set1 3477 A22 S26 | 9.6 | 19.8 | 40.9 | 2.0 | 2.6 | 10.9 |
| Set1 865 A22 S26 | 12.0 | 24.5 | 57.3 | 3.3 | 7.5 | 14.2 |
| Set1 1249 A22 S26 | 34.4 | 71.2 | 73.3 | 7.9 | 24.7 | 12.3 |
| Set1 1250 A22 S26 | 12.0 | 30.6 | 61.6 | 2.0 | 8.4 | 4.2 |
| Set1 2202 A22 S26 | 8.3 | 14.0 | 45.8 | 3.1 | 1.8 | 12.2 |
| Set1 1545 A22 S26 | 34.4 | 62.0 | 81.5 | 11.6 | 4.1 | 12.5 |
| Set1 1755 A22 S26 | 8.7 | 21.9 | 64.9 | 1.0 | 6.4 | 8.0 |
| Set1 254 A25 S27 | 6.3 | 12.3 | 17.6 | 1.2 | 3.4 | 1.7 |
| Set1 703 A25 S27 | 7.0 | 13.7 | 32.8 | 1.2 | 2.9 | 8.0 |
| Set1 709 A25 S27 | 5.6 | 11.4 | 23.4 | 1.8 | 0.5 | 7.7 |
| Set1 895 A25 S27 | 6.6 | 13.5 | 35.7 | 1.9 | 2.5 | 6.8 |
| Set1 1816 A25 S27 | 7.8 | 15.6 | 26.4 | 1.3 | 1.2 | 4.8 |
| Set1 1974 A25 S27 | 8.1 | 16.2 | 34.7 | 2.6 | 1.3 | 3.8 |
| Set1 2425 A25 S27 | 7.8 | 16.5 | 35.3 | 1.0 | 2.2 | 2.5 |
| Set1 3146 A25 S27 | 4.9 | 11.9 | 31.0 | 0.3 | 1.3 | 4.2 |
| Set1 889 A25 S27 | 9.3 | 15.0 | 37.2 | 1.3 | 1.9 | 4.1 |
| Set1 1814 A25 S27 | 6.2 | 13.7 | 43.2 | 1.1 | 0.9 | 6.1 |
| Set1 1245 A25 S27 | 7.2 | 15.2 | 36.2 | 0.3 | 2.4 | 11.7 |
| Set1 3196 A25 S27 | 5.5 | 10.3 | 24.2 | 1.4 | 0.8 | 2.1 |
| Set1 1450 A25 S27 | 4.3 | 10.4 | 29.9 | 1.1 | 1.1 | 6.4 |
| Set1 3169 A25 S27 | 4.3 | 11.5 | 22.0 | 0.4 | 2.3 | 2.7 |
| Set1 3477 A25 S27 | 7.5 | 12.8 | 22.8 | 1.1 | 1.3 | 2.1 |
| Set1 865 A25 S27 | 5.1 | 10.9 | 18.1 | 0.7 | 1.2 | 2.9 |
| Set1 1249 A25 S27 | 8.0 | 22.9 | 37.2 | 1.8 | 5.1 | 6.7 |
| Set1 1250 A25 S27 | 16.6 | 28.2 | 49.1 | 3.1 | 2.7 | 8.9 |
| Set1 2202 A25 S27 | 6.1 | 10.0 | 29.2 | 2.3 | 3.6 | 4.8 |
| Set1 1545 A25 S27 | 9.0 | 16.6 | 41.9 | 1.3 | 2.2 | 2.2 |
| Set1 1755 A25 S27 | 5.8 | 15.1 | 33.8 | 1.2 | 2.2 | 6.1 |
| Set1 254 A LO V1 S26 | 6.0 | 16.4 | 32.9 | 0.3 | 3.8 | 5.1 |
| Set1 703 A LO V1 S26 | 8.1 | 22.7 | 50.3 | 2.8 | 3.4 | 16.2 |
| Set1 709 A LO V1 S26 | 6.2 | 14.8 | 37.1 | 1.2 | 1.7 | 5.1 |
| Set1 895 A LO V1 S26 | 42.7 | 63.9 | 82.3 | 7.8 | 15.5 | 10.2 |
| Set1 1816 A LO V1 S26 | 6.9 | 16.9 | 43.4 | 0.9 | 1.4 | 15.1 |
| Set1 1974 A LO V1 S26 | 9.0 | 18.5 | 36.8 | 1.4 | 3.6 | 6.8 |
| Set1 2425 A LO V1 S26 | 5.5 | 13.9 | 30.0 | 0.4 | 1.6 | 7.5 |
| Set1 3146 A LO V1 S26 | 12.1 | 27.7 | 61.2 | 1.5 | 2.7 | 3.8 |
| Set1 889 A LO V1 S26 | 24.5 | 37.8 | 60.3 | 3.2 | 3.2 | 9.1 |
| Set1 1814 A LO V1 S26 | 8.6 | 20.7 | 46.5 | 1.5 | 2.6 | 11.1 |
| Set1 1245 A LO V1 S26 | 42.0 | 61.4 | 85.9 | 5.8 | 8.4 | 10.4 |
| Set1 3196 A LO V1 S26 | 6.1 | 14.0 | 31.0 | 0.6 | 1.2 | 5.4 |
| Set1 1450 A LO V1 S26 | 9.4 | 21.1 | 47.6 | 1.4 | 1.3 | 8.0 |
| Set1 3169 A LO V1 S26 | 5.3 | 15.5 | 30.5 | 1.3 | 3.7 | 1.9 |
| Set1 3477 A LO V1 S26 | 8.6 | 16.9 | 39.8 | 1.0 | 1.0 | 2.3 |
| Set1 865 A LO V1 S26 | 5.5 | 18.1 | 34.5 | 0.9 | 3.1 | 11.0 |
| Set1 1249 A LO V1 S26 | 61.0 | 90.3 | 82.0 | 5.6 | 29.0 | 6.6 |
| Set1 1250 A LO V1 S26 | 11.3 | 23.1 | 58.2 | 0.9 | 3.0 | 5.1 |
| Set1 2202 A LO V1 S26 | 5.7 | 14.5 | 45.2 | 1.0 | 1.4 | 1.5 |
| Set1 1545 A LO V1 S26 | 5.6 | 13.1 | 38.6 | 0.4 | 0.9 | 3.2 |
| Set1 1755 A LO V1 S26 | 39.5 | 53.6 | 77.5 | 3.8 | 3.3 | 5.0 |
| Set1 254 A LO V2 S LO V1 | 8.7 | 18.6 | 44.9 | 2.5 | 1.4 | 6.6 |
| Set1 703 A LO V2 S LO V1 | 39.9 | 51.7 | 75.8 | 3.9 | 3.2 | 9.9 |
| Set1 709 A LO V2 S LO V1 | 9.2 | 20.3 | 45.0 | 1.2 | 0.7 | 8.7 |
| Set1 895 A LO V2 S LO V1 | 33.3 | 64.9 | 84.8 | 1.8 | 6.5 | 5.8 |
| Set1 1816 A LO V2 S LO V1 | 14.4 | 33.1 | 61.2 | 2.2 | 2.9 | 9.3 |
| Set1 1974 A LO V2 S LO V1 | 56.7 | 65.4 | 91.8 | 15.4 | 5.6 | 6.7 |
| Set1 2425 A LO V2 S LO V1 | 13.3 | 21.4 | 54.2 | 1.5 | 3.6 | 6.0 |
| Set1 3146 A LO V2 S LO V1 | 9.7 | 16.7 | 32.7 | 2.0 | 1.7 | 5.0 |
| Set1 889 A LO V2 S LO V1 | 18.0 | 34.6 | 58.8 | 1.4 | 4.2 | 7.0 |
| Set1 1814 A LO V2 S LO V1 | 8.9 | 18.5 | 44.1 | 3.3 | 5.0 | 1.0 |
| Set1 1245 A LO V2 S LO V1 | 52.2 | 43.1 | 93.4 | 13.1 | 4.1 | 6.2 |
| Set1 3196 A LO V2 S LO V1 | 7.8 | 15.1 | 28.0 | 2.7 | 3.1 | 2.5 |
| Set1 1450 A LO V2 S LO V1 | 6.6 | 14.4 | 35.0 | 0.4 | 2.0 | 4.0 |
| Set1 3169 A LO V2 S LO V1 | 5.3 | 14.5 | 26.4 | 0.5 | 2.8 | 2.2 |
| Set1 3477 A LO V2 S LO V1 | 9.4 | 22.0 | 35.2 | 1.5 | 0.8 | 1.6 |
| Set1 865 A LO V2 S LO V1 | 11.2 | 18.5 | 45.9 | 5.4 | 4.2 | 18.2 |
| Set1 1249 A LO V2 S LO V1 | 65.5 | 97.0 | 82.0 | 19.2 | 22.0 | 10.3 |
| Set1 1250 A LO V2 S LO V1 | 49.4 | 62.9 | 92.4 | 6.3 | 19.6 | 22.4 |
| Set1 2202 A LO V2 S LO V1 | 6.7 | 17.3 | 34.9 | 0.8 | 3.6 | 1.6 |
| Set1 1545 A LO V2 S LO V1 | 17.9 | 32.6 | 58.3 | 1.2 | 5.0 | 8.2 |

TABLE 6-continued

Analysis of RNAi agents to Beta-Catenin
Additional duplexes targeting Beta-Catenin (listed in Table 3) were tested in vitro against
HeLa cells. 48 hour results were measured; duplex concentration was 6 nM, 3 nM and 1.5 nM.
Data in this table represents residual gene activity; thus Set1 254 A22 S26 showed 4.9%
residual gene activity (e.g., 95.1% gene knockdown) at 48 hours at 6 nM in HeLa cells.

| Nickname | AV HeLa set1-2 d3-6 nM | AV HeLa set1-2 3 nM | AV HeLa set1-2 1.5 nM | SD HeLa set1-2 d3-6 nM | SD HeLa set1-2 3 nM | SD HeLa set1-2 1.5 nM |
|---|---|---|---|---|---|---|
| Set1 1755 A LO V2 S LO V1 | 10.5 | 23.3 | 43.1 | 1.0 | 3.3 | 7.3 |
| Set2 254 A LO V3 S LO V2 | 15.0 | 88.6 | 75.0 | 3.4 | 21.7 | 4.4 |
| Set2 703 A LO V3 S LO V2 | 112.0 | 235.3 | 135.2 | 25.2 | 30.1 | 22.4 |
| Set2 709 A LO V3 S LO V2 | 36.7 | 93.6 | 98.4 | 2.6 | 7.6 | 4.8 |
| Set2 895 A LO V3 S LO V2 | 80.2 | 163.3 | 117.7 | 9.1 | 62.4 | 10.6 |
| Set2 1816 A LO V3 S LO V2 | 66.3 | 113.1 | 116.6 | 10.0 | 22.2 | 12.6 |
| Set2 1974 A LO V3 S LO V2 | 110.7 | 142.7 | 134.5 | 13.1 | 19.0 | 12.8 |
| Set2 2425 A LO V3 S LO V2 | 50.9 | 119.3 | 151.5 | 13.1 | 20.2 | 7.0 |
| Set2 3146 A LO V3 S LO V2 | 30.8 | 73.2 | 99.6 | 5.0 | 13.5 | 14.3 |
| Set2 889 A LO V3 S LO V2 | 72.5 | 135.6 | 112.8 | 12.0 | 37.8 | 9.4 |
| Set2 1814 A LO V3 S LO V2 | 80.7 | 129.6 | 133.9 | 23.6 | 13.9 | 15.2 |
| Set2 1245 A LO V3 S LO V2 | 94.9 | 128.9 | 129.1 | 13.2 | 18.1 | 13.8 |
| Set2 3196 A LO V3 S LO V2 | 20.5 | 69.2 | 89.8 | 1.4 | 8.7 | 15.8 |
| Set2 1450 A LO V3 S LO V2 | 35.3 | 95.3 | 109.0 | 1.6 | 15.1 | 16.1 |
| Set2 3169 A LO V3 S LO V2 | 26.2 | 90.9 | 85.7 | 8.9 | 26.1 | 7.7 |
| Set2 3477 A LO V3 S LO V2 | 16.3 | 71.8 | 68.0 | 3.7 | 20.3 | 2.2 |
| Set2 865 A LO V3 S LO V2 | 99.3 | 122.9 | 115.4 | 9.0 | 29.0 | 14.5 |
| Set2 1249 A LO V3 S LO V2 | 62.7 | 114.9 | 113.5 | 7.5 | 19.6 | 3.4 |
| Set2 1250 A LO V3 S LO V2 | 101.9 | 112.5 | 116.1 | 8.7 | 12.1 | 11.1 |
| Set2 2202 A LO V3 S LO V2 | 72.2 | 118.5 | 129.7 | 7.1 | 22.3 | 7.5 |
| Set2 1545 A LO V3 S LO V2 | 65.6 | 109.5 | 120.7 | 12.9 | 6.5 | 9.3 |
| Set2 1755 A LO V3 S LO V2 | 84.7 | 140.6 | 146.9 | 11.1 | 52.2 | 13.5 |
| Set2 254 A LO V4 S LO V1 | 11.2 | 50.5 | 59.8 | 1.4 | 4.6 | 4.5 |
| Set2 703 A LO V4 S LO V1 | 29.1 | 94.0 | 100.5 | 3.4 | 10.3 | 6.1 |
| Set2 709 A LO V4 S LO V1 | 6.3 | 25.9 | 32.9 | 0.2 | 2.6 | 2.2 |
| Set2 895 A LO V4 S LO V1 | 26.4 | 86.4 | 108.5 | 1.2 | 6.5 | 30.8 |
| Set2 1816 A LO V4 S LO V1 | 15.0 | 94.1 | 88.1 | 1.5 | 13.2 | 25.2 |
| Set2 1974 A LO V4 S LO V1 | 47.3 | 100.2 | 126.0 | 9.1 | 4.5 | 21.6 |
| Set2 2425 A LO V4 S LO V1 | 13.0 | 44.3 | 61.8 | 3.7 | 1.7 | 6.9 |
| Set2 3146 A LO V4 S LO V1 | 11.8 | 36.2 | 34.8 | 2.5 | 2.4 | 3.6 |
| Set2 889 A LO V4 S LO V1 | 28.9 | 79.6 | 79.8 | 9.2 | 13.4 | 10.7 |
| Set2 1814 A LO V4 S LO V1 | 10.4 | 50.1 | 62.9 | 0.9 | 17.3 | 9.2 |
| Set2 1245 A LO V4 S LO V1 | 31.7 | 88.0 | 105.1 | 5.3 | 18.8 | 14.2 |
| Set2 3196 A LO V4 S LO V1 | 9.8 | 27.2 | 39.2 | 1.1 | 1.4 | 4.9 |
| Set2 1450 A LO V4 S LO V1 | 8.9 | 27.8 | 44.0 | 2.1 | 7.6 | 10.9 |
| Set2 3169 A LO V4 S LO V1 | 8.1 | 26.3 | 29.7 | 1.4 | 7.1 | 6.6 |
| Set2 3477 A LO V4 S LO V1 | 7.9 | 19.2 | 29.1 | 0.6 | 2.5 | 9.5 |
| Set2 865 A LO V4 S LO V1 | 6.2 | 23.8 | 33.4 | 0.6 | 0.7 | 5.6 |
| Set2 1249 A LO V4 S LO V1 | 69.5 | 103.4 | 103.4 | 19.1 | 17.3 | 11.8 |
| Set2 1250 A LO V4 S LO V1 | 61.4 | 90.3 | 94.6 | 15.3 | 12.4 | 11.7 |
| Set2 2202 A LO V4 S LO V1 | 9.3 | 35.7 | 42.8 | 2.9 | 6.9 | 5.5 |
| Set2 1545 A LO V4 S LO V1 | 32.8 | 68.0 | 92.2 | 6.1 | 17.1 | 23.2 |
| Set2 1755 A LO V4 S LO V1 | 13.9 | 50.4 | 62.0 | 3.6 | 4.6 | 12.5 |
| Set2 254 A LO V5 S LO V1 | 11.4 | 28.3 | 52.5 | 1.8 | 8.2 | 4.8 |
| Set2 703 A LO V5 S LO V1 | 31.1 | 88.4 | 97.0 | 1.4 | 14.7 | 6.3 |
| Set2 709 A LO V5 S LO V1 | 13.0 | 34.2 | 37.9 | 3.4 | 8.8 | 5.7 |
| Set2 895 A LO V5 S LO V1 | 25.9 | 81.1 | 109.1 | 3.0 | 8.2 | 20.0 |
| Set2 1816 A LO V5 S LO V1 | 12.9 | 42.3 | 53.7 | 2.5 | 7.0 | 12.1 |
| Set2 1974 A LO V5 S LO V1 | 39.5 | 80.3 | 93.6 | 11.6 | 5.5 | 10.4 |
| Set2 2425 A LO V5 S LO V1 | 11.5 | 38.8 | 59.9 | 1.4 | 5.4 | 3.3 |
| Set2 3146 A LO V5 S LO V1 | 9.3 | 32.1 | 41.6 | 0.7 | 5.6 | 4.3 |
| Set2 889 A LO V5 S LO V1 | 26.9 | 64.9 | 89.5 | 5.2 | 23.5 | 17.5 |
| Set2 1814 A LO V5 S LO V1 | 11.0 | 47.9 | 79.5 | 1.5 | 9.1 | 11.6 |
| Set2 1245 A LO V5 S LO V1 | 29.5 | 78.6 | 127.3 | 2.2 | 5.1 | 16.7 |
| Set2 3196 A LO V5 S LO V1 | 8.1 | 28.6 | 55.6 | 0.7 | 9.8 | 9.7 |
| Set2 1450 A LO V5 S LO V1 | 6.6 | 27.8 | 46.3 | 1.6 | 12.7 | 12.4 |
| Set2 3169 A LO V5 S LO V1 | 7.8 | 24.2 | 32.6 | 1.5 | 0.8 | 5.5 |
| Set2 3477 A LO V5 S LO V1 | 11.5 | 46.6 | 57.9 | 2.3 | 25.4 | 7.1 |
| Set2 865 A LO V5 S LO V1 | 11.4 | 35.2 | 40.9 | 1.6 | 8.6 | 6.7 |
| Set2 1249 A LO V5 S LO V1 | 52.0 | 82.3 | 89.6 | 3.2 | 3.0 | 12.9 |
| Set2 1250 A LO V5 S LO V1 | 45.0 | 75.2 | 97.3 | 6.1 | 4.2 | 13.0 |
| Set2 2202 A LO V5 S LO V1 | 5.8 | 26.1 | 35.7 | 0.8 | 5.2 | 4.2 |
| Set2 1545 A LO V5 S LO V1 | 23.8 | 59.7 | 73.5 | 3.5 | 18.3 | 11.0 |
| Set2 1755 A LO V5 S LO V1 | 10.8 | 40.5 | 73.9 | 0.8 | 10.6 | 4.8 |
| Set2 254 A48 S26 | 7.3 | 20.0 | 36.8 | 0.8 | 1.5 | 1.7 |
| Set2 703 A48 S26 | 7.4 | 27.7 | 48.1 | 0.7 | 2.6 | 5.7 |
| Set2 709 A48 S26 | 10.3 | 35.4 | 42.0 | 0.3 | 12.1 | 1.3 |
| Set2 895 A48 S26 | 8.7 | 30.7 | 64.5 | 0.7 | 6.6 | 8.0 |
| Set2 1816 A48 S26 | 10.0 | 29.4 | 36.0 | 1.8 | 6.7 | 7.5 |

TABLE 6-continued

Analysis of RNAi agents to Beta-Catenin
Additional duplexes targeting Beta-Catenin (listed in Table 3) were tested in vitro against HeLa cells. 48 hour results were measured; duplex concentration was 6 nM, 3 nM and 1.5 nM. Data in this table represents residual gene activity; thus Set1 254 A22 S26 showed 4.9% residual gene activity (e.g., 95.1% gene knockdown) at 48 hours at 6 nM in HeLa cells.

| Nickname | AV HeLa set1-2 d3-6 nM | AV HeLa set1-2 3 nM | AV HeLa set1-2 1.5 nM | SD HeLa set1-2 d3-6 nM | SD HeLa set1-2 3 nM | SD HeLa set1-2 1.5 nM |
|---|---|---|---|---|---|---|
| Set2 1974 A48 S26 | 9.3 | 27.7 | 45.1 | 1.3 | 7.5 | 2.3 |
| Set2 2425 A48 S26 | 8.2 | 38.6 | 40.5 | 1.8 | 2.5 | 6.6 |
| Set2 3146 A48 S26 | 5.8 | 22.4 | 28.5 | 0.5 | 2.2 | 5.6 |
| Set2 889 A48 S26 | 7.2 | 21.9 | 30.6 | 0.9 | 5.9 | 2.8 |
| Set2 1814 A48 S26 | 7.3 | 19.3 | 25.2 | 2.6 | 7.8 | 7.6 |
| Set2 1245 A48 S26 | 8.3 | 47.7 | 58.2 | 2.0 | 19.3 | 10.5 |
| Set2 3196 A48 S26 | 8.0 | 20.2 | 27.0 | 0.4 | 6.9 | 7.2 |
| Set2 1450 A48 S26 | 7.5 | 27.4 | 40.4 | 1.8 | 9.7 | 6.6 |
| Set2 3169 A48 S26 | 8.4 | 18.2 | 30.5 | 0.8 | 3.1 | 7.4 |
| Set2 3477 A48 S26 | 12.5 | 44.1 | 59.8 | 2.2 | 10.3 | 5.5 |
| Set2 865 A48 S26 | 13.0 | 38.2 | 42.5 | 2.4 | 5.3 | 8.4 |
| Set2 1249 A48 S26 | 47.7 | 74.5 | 88.6 | 9.0 | 13.3 | 12.3 |
| Set2 1250 A48 S26 | 11.5 | 56.4 | 66.0 | 2.4 | 7.2 | 7.4 |
| Set2 2202 A48 S26 | 6.7 | 28.1 | 33.2 | 0.8 | 5.4 | 4.9 |
| Set2 1545 A48 S26 | 37.0 | 72.7 | 61.7 | 10.9 | 13.6 | 24.3 |
| Set2 1755 A48 S26 | 8.4 | 25.9 | 39.7 | 2.4 | 4.7 | 6.4 |

Example 4

Screening in Insensitive Cells

In various embodiments, preferred RNAi agents to Beta-Catenin are those which are specific to Beta-Catenin and, in effect, do not exhibit off-target effects. Thus, in order to continue lead selection, various RNAi agents to Beta-Catenin are tested against cell lines which produce little or no Beta-Catenin. The Beta-Catenin RNAi agents which do not greatly reduce viability of these so-called "insensitive cell lines" are thought to have little or not off-target effects. The "insensitive" cell lines used are NCI-H28 and RKO. NCI-H28 is a mesothelioma cell line in which the Beta-Catenin gene has been deleted; RKO is a colorectal cell line which has low or no Beta-Catenin expression.

105 RNAi agents to Beta-Catenin found had been found to be effective in the dose-response analysis. These are tested against "insensitive" cell lines used are NCI-H28 and RKO at doses of 50 nM, 10 nM, 1 nM, 0.1 nM, and 0.0001 nM, and cell viability is determined at the time points of 3, 5 and 7 days.

The following RNAi agents demonstrate at least 80% viability (no more than 20% growth inhibition) of RKO cells and at least 80% viability of NCI-H28 cells on day 5, at 50 or 10 nM.

TABLE 7

| RNAi agent | IC50 |
|---|---|
| AD-18963-b2 | 0.049 |
| AD-25894-b1 | 0.004 |
| AD-25914-b1 | 0.054 |
| AD-25956-b1 | 0.042 |
| AD-26028-b1 | 0.050 |
| AD-26034-b1 | 0.009 |
| AD-26108-b1 | 0.030 |
| AD-26131-b1 | 0.104 |
| AD-26134-b1 | 0.103 |
| AD-26158-b1 | 0.033 |
| AD-26193-b1 | 0.055 |
| AD-26218-b1 | 0.026 |
| AD-26652-b1 | 0.026 |

TABLE 7-continued

| RNAi agent | IC50 |
|---|---|
| AD-26704-b1 | 0.010 |
| AD-26900-b1 | 0.033 |
| AD-26918-b1 | 0.029 |

The following RNAi agents demonstrate at least 80% viability (no more than 20% growth inhibition) of RKO cells and about 60 to 80% viability of NCI-H28 cells on day 5, at 50 or 10 nM.

TABLE 8

| RNAi Agent | IC50 |
|---|---|
| AD-18983-b2 | 0.070 |
| AD-25893-b1 | 0.040 |
| AD-25918-b1 | 0.013 |
| AD-25943-b1 | 0.080 |
| AD-25944-b1 | 0.007 |
| AD-25951-b1 | 0.007 |
| AD-25958-b1 | 0.024 |
| AD-26068-b1 | 0.102 |
| AD-26109-b1 | 0.025 |
| AD-26156-b1 | 0.020 |
| AD-26673-b1 | 0.012 |
| AD-26682-b1 | 0.007 |
| AD-26696-b1 | 0.027 |
| AD-26740-b1 | 0.006 |
| AD-26752-b1 | 0.042 |
| AD-26757-b1 | 0.047 |
| AD-26779-b1 | 0.109 |
| AD-26788-b1 | 0.053 |
| AD-26800-b1 | 0.025 |

Thus, 35 RNAi agents to Beta-Catenin did not greatly reduce viability of cell lines which do not depend on Beta-Catenin; these 35 RNAi agents to Beta-Catenin are: AD-18963-b2, AD-18983-b2, AD-25893-b1, AD-25894-b1, AD-25914-b1, AD-25918-b1, AD-25943-b1, AD-25944-b1, AD-25951-b1, AD-25956-b1, AD-25958-b1, AD-26028-b1, AD-26034-b1, AD-26068-b1, AD-26108-b1, AD-26109-b1, AD-26131-b1, AD-26134-b1, AD-26156-b1, AD-26158-b1, AD-26193-b1, AD-26218-b1, AD-26652-b1, AD-26673-b1, AD-26682-b1, AD-26696-b1, AD-26704-b1, AD-26740-b1, AD-26752-b1, AD-26757-b1, AD-26779-b1, AD-26788-b1, AD-26800-b1, AD-26900-b1, and AD-26918-b1 (wherein "b1" indicates "batch 1").

Example 5

Screening in Sensitive Cell Lines

Further screening is performed on the 35 RNAi agents to Beta-Catenin which were able to reduce Beta-Catenin expression in vitro, and did which did not greatly reduce viability of cell lines which do not depend on Beta-Catenin, as shown in the previous Examples.

These 35 RNAi agents were tested on four colorectal cell lines with an APC mutation (LoVo, DLD-1, LS411N and SW403). In the wild-type Wnt pathway, Beta-Catenin protein is phosphorylated by GSK-3, and then degraded by APC; thus, Beta-Catenin protein levels do not accumulate. However, in the case of the APC mutation, the Beta-Catenin is not degraded and thus the protein accumulates. These four cell lines are, in fact, dependent on Beta-Catenin and stop growing if Beta-Catenin expression is down-regulated.

The cell lines are each treated with each of the 35 RNAi agents to Beta-Catenin at doses of 50 nM, 10 nM, 1 nM, 0.1 nM, and 0.0001 nM, and tested at 3, 5 and 7 days. The data used are from DLD-1 treated at 1 nM, LoVo at 1 nM, and LS411N at 0.1 nM, and data collected at 7 days. SW403 data is not used, as these data did not distinguish among the various siRNAs even at 0.1 nM.

The screening data for RNAi agents to Beta-Catenin in sensitive cell lines is presented below.

TABLE 9

SCREENING DATA

| siRNA | Pos | Species | 24 hr Average IC50 (nM) | DLD1 1 nM Day 7 | LoVo 1 nM Day 7 | LS411N 0.1 nM Day 7 | PBMC |
| --- | --- | --- | --- | --- | --- | --- | --- |
| AD-18983 | CDS | Hu, Cy, Mo | 0.07 | 0.258 | 0.150 | 0.054 | Neg |
| AD-26156 | CDS | Hu, Cy, Mo | 0.02 | 0.458 | 0.194 | 0.187 | Neg |
| AD-25951 | 3'UTR | Hu, Cy | 0.007 | 0.659 | 0.188 | 0.465 | Neg |
| AD-26109 | CDS | Hu, Cy | 0.025 | 0.156 | 0.172 | 0.410 | Neg |
| AD-26218 | CDS | Hu, Cy | 0.026 | 0.376 | 0.243 | 0.566 | Neg |
| AD-25894 | 3'UTR | Hu, Cy | 0.004 | 0.378 | 0.293 | 0.307 | Neg |
| AD-26740 | CDS | Hu, Cy | 0.006 | 0.511 | 0.227 | 0.330 | Neg |
| AD-26158 | CDS | Hu, Cy | 0.033 | 0.347 | 0.227 | 0.398 | Neg |
| AD-26682 | CDS | Hu, Cy | 0.007 | 0.484 | 0.297 | 0.923 | Neg |
| AD-26034 | CDS | Hu, Cy | 0.009 | 0.673 | 0.267 | 0.656 | Neg |
| AD-25944 | 3'UTR | Hu, Cy | 0.007 | 0.633 | 0.264 | 0.589 | Neg |
| AD-26800 | CDS | Hu, Cy | 0.025 | 0.449 | 0.240 | 0.815 | Neg |
| AD-26108 | CDS | Hu, Cy | 0.03 | 0.437 | 0.305 | 0.880 | Neg |
| AD-26752 | CDS | Hu, Cy | 0.042 | 0.518 | 0.396 | 0.500 | Neg |
| AD-26918 | 3'UTR | Hu, Cy | 0.029 | 0.371 | 0.345 | 0.965 | Neg |

In this table, the position is shown, wherein CDS indicates the coding segment (or open reading frame), and 3'UTR indicates the 3' untranslated region. The species forms of Beta-Catenin to which the RNAi agents match is also shown. Thus, AD-18983 matches each of the hman (Hu), cynomolgus (Cy), and Mouse (Mo) forms of Beta-Catenin. The estimated 24-hr average IC50 is shown (in nM). The cell viability in DLD1, LoVo, and LS411N cells is shown. For AD-18983, "0.258" indicates that at 1 nM at day 7, there was 25.8% cell viability of DLD1 cells, or 74.2% viability reduction. Similarly, there was 15.0% cell viability of LoVo cells (85.5% viability reduction) at 1 nM, and 5.4% cell viability (94.6% viability reduction) of LS411N cells (at 0.1 nM). PBMC indicates the peripheral blood mononuclear cell assay used as a test to measure potential immunogenicity of RNAi agents; "Neg" indicates that the RNAi agents did not illicit an immune response, as indicated by an increase in INF-α and TNF-α.

Thus, the following RNAi agents to Beta-Catenin demonstrated a significant reduction of cell viability in at least one colorectal cell line that depends on Beta-Catenin for growth: AD-18963-b2, AD-25894-b1, AD-25944-b1, AD-25951-b1, AD-26034-b1, AD-26108-b1, AD-26109-b1, AD-26156-b1, AD-26158-b1, AD-26218-b1, AD-26682-b1, AD-26740-b1, AD-26752-b1, AD-26800-b1, and AD-26918-b1.

EQUIVALENTS

A composition of embodiment 1 is a composition comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-Catenin provided in Table 1.

The composition of embodiment 1, wherein the composition further comprises a second RNAi agent to Beta-Catenin.

The composition of embodiment 1, wherein the antisense strand is 30 or fewer nucleotides in length.

The composition of embodiment 1, wherein the sense strand and the antisense strand form a duplex region 15 to 30 nucleotide pairs in length.

The composition of embodiment 1, wherein the antisense strand and the sense strand are independently 19 to 23 nucleotides in length.

The composition of embodiment 1, wherein the RNAi agent comprises a modification that causes the RNAi agent to have increased stability in a biological sample or environment.

The composition of embodiment 1, wherein the RNAi agent comprises at least one modified backbone and/or at least one 2'-modified nucleotide.

The composition of embodiment 1, wherein the RNAi agent comprises:
  a) at least one 5'-uridine-adenine-3' (5'-ua-3') dinucleotide, wherein the uridine is a 2'-modified nucleotide; and/or
  b) at least one 5'-uridine-guanine-3' (5'-ug-3') dinucleotide, wherein the 5'-uridine is a 2'-modified nucleotide; and/or c) at least one 5'-cytidine-adenine-3' (5'-ca-3') dinucleotide, wherein the 5'-cytidine is a 2'-modified nucleotide; and/or d) at least one 5'-uridine-uridine-3' (5'-uu-3') dinucleotide, wherein the 5'-uridine is a 2'-modified nucleotide.

The composition of embodiment 1, wherein the RNAi agent comprises a 2'-modification selected from the group consisting of: 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), and 2'-O—N-methylacetamido (2'-O-NMA).

The composition of embodiment 1, wherein the RNAi agent comprises a blunt end.

The composition of embodiment 1, wherein the RNAi agent comprises an overhang having 1 to 4 unpaired nucleotides.

The composition of embodiment 1, wherein the RNAi agent comprises an overhang at the 3'-end of the antisense strand of the RNAi agent.

The composition of embodiment 1, wherein the RNAi agent is ligated to one or more agent selected from: one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

The composition of embodiment 1, wherein the RNAi agent is capable of inhibiting expression of the Beta-Catenin gene by at least about 60% at a concentration of 10 nM in HeLa, GTL-16, or SK-BR-3 cells in vitro.

The composition of embodiment 1, wherein the RNAi agent is capable of inhibiting expression of the Beta-Catenin gene by at least about 70% at a concentration of 10 nM in HeLa, GTL-16, or SK-BR-3 cells in vitro.

The composition of embodiment 1, wherein the RNAi agent is capable of inhibiting expression of the Beta-Catenin gene by at least about 80% at a concentration of 10 nM in HeLa, GTL-16, or SK-BR-3 cells in vitro.

The composition of embodiment 1, wherein the RNAi agent is capable of inhibiting expression of the Beta-Catenin gene by at least about 90% at a concentration of 10 nM in HeLa, GTL-16, or SK-BR-3 cells in vitro.

The composition of embodiment 1, wherein the RNAi has an EC50 of no more than about 0.1 nM.

The composition of embodiment 1, wherein the RNAi has an EC50 of no more than about 0.01 nM.

The composition of embodiment 1, wherein the RNAi has an EC50 of no more than about 0.001 nM.

A composition of embodiment 2 is a composition comprising a RNAi agent comprising a first strand and a second strand, wherein the first strand and second strand comprise at least 15 contiguous nucleotides differing by 0, 1, 2, or 3 nucleotides from the first and second strand, respectively, of a RNAi agent specific to Beta-Catenin provided in Table 1.

The composition of embodiment 2, wherein the composition comprises a second RNAi agent to Beta-Catenin.

The composition of embodiment 2, wherein the second strand is 30 or fewer nucleotides in length.

The composition of embodiment 2, wherein the first strand and the second strand form a duplex region 15 to 30 nucleotide pairs in length.

The composition of embodiment 2, wherein the first strand and the second strand are independently 19 to 23 nucleotides in length.

The composition of embodiment 2, wherein the RNAi agent comprises a modification that causes the RNAi agent to have increased stability in a biological sample or environment.

The composition of embodiment 2, wherein the RNAi agent comprises a phosphorothioate and/or a 2'-modified nucleotide.

The composition of embodiment 2, wherein the RNAi agent comprises:

at least one 5'-uridine-adenine-3' (5'-ua-3') dinucleotide, wherein the uridine is a 2'-modified nucleotide; and/or at least one 5'-uridine-guanine-3' (5'-ug-3') dinucleotide, wherein the 5'-uridine is a 2'-modified nucleotide;

and/or at least one 5'-cytidine-adenine-3' (5'-ca-3') dinucleotide, wherein the 5'-cytidine is a 2'-modified nucleotide;

and/or at least one 5'-uridine-uridine-3' (5'-uu-3') dinucleotide, wherein the 5'-uridine is a 2'-modified nucleotide.

The composition of embodiment 2, wherein the RNAi agent comprises one or more 2'-modifications selected from the group consisting of:

2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-0-DMAP), 2'-O-dimethylaminoethyloxyethyl (2'-O-DMAEOE), and 2'-O—N-methylacetamido (2'-O-NMA).

The composition of embodiment 2, wherein the RNAi agent comprises a blunt end.

The composition of embodiment 2, wherein the RNAi agent comprises an overhang having 1 to 4 unpaired nucleotides.

The composition of embodiment 2, wherein the RNAi agent comprises an overhang at the 3'-end of the antisense strand.

The composition of embodiment 2, wherein the RNAi agent is ligated to one or more agents, the agent selected from a: one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

The composition of embodiment 2, wherein the RNAi agent is capable of inhibiting expression of the Beta-Catenin gene by at least about 60% at a concentration of 10 nM in HeLa, GTL-16, or SK-BR-3 cells in vitro.

The composition of embodiment 2, wherein the RNAi agent is capable of inhibiting expression of the Beta-Catenin gene by at least about 70% at a concentration of 10 nM in HeLa, GTL-16, or SK-BR-3 cells in vitro.

The composition of embodiment 2, wherein the RNAi agent is capable of inhibiting expression of the Beta-Catenin gene by at least about 80% at a concentration of 10 nM in HeLa, GTL-16, or SK-BR-3 cells in vitro.

The composition of embodiment 2, wherein the RNAi agent is capable of inhibiting expression of the Beta-Catenin gene by at least about 90% at a concentration of 10 nM in HeLa, GTL-16, or SK-BR-3 cells in vitro.

The composition of embodiment 2, wherein the RNAi has an EC50 of no more than about 0.1 nM.

The composition of embodiment 2, wherein the RNAi has an EC50 of no more than about 0.01 nM.

The composition of embodiment 2, wherein the RNAi has an EC50 of no more than about 0.001 nM.

A method of embodiment 3 is a method comprising a method of treating a Beta-Catenin-related disease in an individual, comprising the step of administering to the individual a therapeutically effective amount of a composition comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-Catenin provided in Table 1.

The method of embodiment 3, wherein the Beta-Catenin-related disease is cancer, autoimmune, or a viral disease.

The method of embodiment 3, wherein the Beta-Catenin-related disease is cancer.

The method of embodiment 3, wherein the method further comprises the step of administering an additional treatment for cancer, autoimmune, or a viral disease.

The method of embodiment 3, wherein the composition comprises a second RNAi agent to Beta-Catenin.

The method of embodiment 3, wherein the method further comprises the step of administering an additional RNAi agent to Beta-Catenin.

The method of embodiment 3, further comprising the administration of an additional treatment.

The method of embodiment 3, wherein the additional treatment is a composition.

The method of embodiment 3, wherein the additional treatment is a method.

The method of embodiment 3, wherein the additional treatment and the RNAi agent can be administered in any order.

A method of embodiment 4 is a method comprising a method of inhibiting the expression of the Beta-Catenin gene in an individual, comprising the step of administering to the individual a therapeutically effective amount of a composition comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-Catenin provided in Table 1.

The method of embodiment 4, wherein the individual is afflicted with or susceptible to a Beta-Catenin-related disease.

The method of embodiment 4, wherein the Beta-Catenin-related disease is cancer, autoimmune, or a viral disease.

The method of embodiment 4, wherein the Beta-Catenin-related disease is cancer.

The method of embodiment 4, further comprising the administration of an additional treatment.

The method of embodiment 4, wherein the additional treatment is a composition.

The method of embodiment 4, wherein the additional treatment is a method.

The method of embodiment 4, wherein the additional treatment and the RNAi agent can be administered in any order.

A composition of embodiment 5 is a composition comprising a medicament for use in an RNAi formulation comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-Catenin provided in Table 1.

Any composition above in a pharmaceutically effective formulation.

The composition according to embodiment 5, for use in a method of treating a Beta-Catenin-related disease in an individual, the method comprising the step of administering to the individual a therapeutically effective amount of a composition according to embodiment 1.

The use of a composition according to embodiment 5, in the manufacture of a medicament for the treatment of a Beta-Catenin-related disease.

The use of embodiment 5, wherein the Beta-Catenin-related disease is cancer, autoimmune, or a viral disease.

The composition of embodiment 5, wherein all the pyrimidines are 2' O-methyl-modified nucleotides.

The composition of embodiment 5, wherein all the pyrimidines are 2' O-methyl-modified nucleotides.

ADDITIONAL EQUIVALENTS

A composition of embodiment 6 is a composition comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-ENaC provided in Table 1.

The composition of embodiment 6, wherein the composition further comprises a second RNAi agent to Beta-ENaC.

The composition of embodiment 6, wherein the antisense strand is 30 or fewer nucleotides in length.

The composition of embodiment 6, wherein the sense strand and the antisense strand form a duplex region 15 to 30 nucleotide pairs in length.

The composition of embodiment 6, wherein the antisense strand and the sense strand are independently 19 to 23 nucleotides in length.

The composition of embodiment 6, wherein the RNAi agent comprises a modification that causes the RNAi agent to have increased stability in a biological sample or environment.

The composition of embodiment 6, wherein the RNAi agent comprises at least one modified backbone and/or at least one 2'-modified nucleotide.

The composition of embodiment 6, wherein the RNAi agent comprises:

a) at least one 5'-uridine-adenine-3' (5'-ua-3') dinucleotide, wherein the uridine is a 2'-modified nucleotide; and/or b) at least one 5'-uridine-guanine-3' (5'-ug-3') dinucleotide, wherein the 5'-uridine is a 2'-modified nucleotide; and/or c) at least one 5'-cytidine-adenine-3' (5'-ca-3') dinucleotide, wherein the 5'-cytidine is a 2'-modified nucleotide; and/or d) at least one 5'-uridine-uridine-3' (5'-uu-3') dinucleotide, wherein the 5'-uridine is a 2'-modified nucleotide.

The composition of embodiment 6, wherein the RNAi agent comprises a 2'-modification selected from the group consisting of: 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), and 2'-O—N-methylacetamido (2'-O-NMA).

The composition of cla embodiment 6, wherein the RNAi agent comprises a blunt end.

The composition of embodiment 6, wherein the RNAi agent comprises an overhang having 1 to 4 unpaired nucleotides.

The composition of embodiment 6, wherein the RNAi agent comprises an overhang at the 3'-end of the antisense strand of the RNAi agent.

The composition of embodiment 6, wherein the RNAi agent is ligated to one or more agent selected from: diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

The composition of embodiment 6, wherein the RNAi agent is capable of inhibiting expression of the Beta-ENaC gene by at least about 60% at a concentration of 10 nM in H441 cells in vitro.

The composition of embodiment 6, wherein the RNAi agent is capable of inhibiting expression of the Beta-ENaC gene by at least about 70% at a concentration of 10 nM in H441 cells in vitro.

The composition of embodiment 6, wherein the RNAi agent is capable of inhibiting expression of the Beta-ENaC gene by at least about 80% at a concentration of 10 nM in H441 cells in vitro.

The composition of embodiment 6, wherein the RNAi agent is capable of inhibiting expression of the Beta-ENaC gene by at least about 90% at a concentration of 10 nM in H441 cells in vitro.

The composition of embodiment 6, wherein the RNAi has an EC50 of no more than about 0.1 nM.

The composition of embodiment 6, wherein the RNAi has an EC50 of no more than about 0.01 nM.

The composition of embodiment 6, wherein the RNAi has an EC50 of no more than about 0.001 nM.

A composition of embodiment 7 is a composition comprising a RNAi agent comprising a first strand and a second strand, wherein the first strand and second strand comprise at least 15 contiguous nucleotides differing by 0, 1, 2, or 3 nucleotides from the first and second strand, respectively, of a RNAi agent specific to Beta-ENaC provided in Table 1.

The composition of embodiment 7, wherein the composition comprises a second RNAi agent to Beta-ENaC.

The composition of embodiment 7, wherein the second strand is 30 or fewer nucleotides in length.

The composition of embodiment 7, wherein the first strand and the second strand form a duplex region 15 to 30 nucleotide pairs in length.

The composition of embodiment 7, wherein the first strand and the second strand are independently 19 to 23 nucleotides in length.

The composition of embodiment 7, wherein the RNAi agent comprises a modification that causes the RNAi agent to have increased stability in a biological sample or environment.

The composition of embodiment 7, wherein the RNAi agent comprises a phosphorothioate and/or a 2'-modified nucleotide.

The composition of embodiment 7, wherein the RNAi agent comprises:

at least one 5'-uridine-adenine-3' (5'-ua-3') dinucleotide, wherein the uridine is a 2'-modified nucleotide; and/or at least one 5'-uridine-guanine-3' (5'-ug-3') dinucleotide, wherein the 5'-uridine is a 2'-modified nucleotide;

and/or at least one 5'-cytidine-adenine-3' (5'-ca-3') dinucleotide, wherein the 5'-cytidine is a 2'-modified nucleotide;

and/or at least one 5'-uridine-uridine-3' (5'-uu-3') dinucleotide, wherein the 5'-uridine is a 2'-modified nucleotide.

The composition of embodiment 7, wherein the RNAi agent comprises one or more 2'-modifications selected from the group consisting of:

2'-deoxy, 2'-deoxy-2'-fluoro, 2'-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-0-DMAP), 2'-O-dimethylaminoethyloxyethyl (2'-O-DMAEOE), and 2'-O—N-methylacetamido (2'-O-NMA).

The composition of embodiment 7, wherein the RNAi agent comprises a blunt end.

The composition of embodiment 7, wherein the RNAi agent comprises an overhang having 1 to 4 unpaired nucleotides.

The composition of embodiment 7, wherein the RNAi agent comprises an overhang at the 3'-end of the antisense strand.

The composition of embodiment 7, wherein the RNAi agent is ligated to one or more agents, the agent selected from a: diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

The composition of embodiment 7, wherein the RNAi agent is capable of inhibiting expression of the Beta-ENaC gene by at least about 60% at a concentration of 10 nM in H441 cells in vitro.

The composition of embodiment 7, wherein the RNAi agent is capable of inhibiting expression of the Beta-ENaC gene by at least about 70% at a concentration of 10 nM in H441 cells in vitro.

The composition of embodiment 7, wherein the RNAi agent is capable of inhibiting expression of the Beta-ENaC gene by at least about 80% at a concentration of 10 nM in H441 cells in vitro.

The composition of embodiment 7, wherein the RNAi agent is capable of inhibiting expression of the Beta-ENaC gene by at least about 90% at a concentration of 10 nM in H441 cells in vitro.

The composition of embodiment 7, wherein the RNAi has an EC50 of no more than about 0.1 nM.

The composition of embodiment 7, wherein the RNAi has an EC50 of no more than about 0.01 nM.

The composition of embodiment 7, wherein the RNAi has an EC50 of no more than about 0.001 nM.

A method of embodiment 8 is a method of treating a Beta-ENaC-related disease in an individual, comprising the step of administering to the individual a therapeutically effective amount of a composition comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-ENaC provided in Table 1.

The method of embodiment 8, wherein the Beta-ENaC-related disease is cystic fibrosis, pseudohypoaldosteronism type 1 (PHA1), Liddle's syndrome, hypertension, alkalosis, hypokalemia, and/or obesity-associated hypertension.

The method of embodiment 8, wherein the Beta-ENaC-related disease is cystic fibrosis.

The method of embodiment 8, wherein the method further comprises the step of administering an additional treatment for cystic fibrosis, pseudohypoaldosteronism type 1 (PHA1), Liddle's syndrome, hypertension, alkalosis, hypokalemia, and/or obesity-associated hypertension.

The method of embodiment 8, wherein the composition comprises a second RNAi agent to Beta-ENaC.

The method of embodiment 8, wherein the method further comprises the step of administering an additional RNAi agent to Beta-ENaC.

The method of embodiment 8, further comprising the administration of an additional treatment.

The method of embodiment 8, wherein the additional treatment is a composition.

The method of embodiment 8, wherein the additional treatment is a method.

The method of embodiment 8, wherein the additional treatment and the RNAi agent can be administered in any order.

A method of embodiment 9 is a method of inhibiting the expression of the Beta-ENaC gene in an individual, comprising the step of administering to the individual a therapeutically effective amount of a composition comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-ENaC provided in Table 1.

The method of embodiment 9, wherein the individual is afflicted with or susceptible to a Beta-ENaC-related disease.

The method of embodiment 9, wherein the Beta-ENaC-related disease is cystic fibrosis, pseudohypoaldosteronism type 1 (PHA1), Liddle's syndrome, hypertension, alkalosis, hypokalemia, and/or obesity-associated hypertension.

The method of embodiment 9, wherein the Beta-ENaC-related disease is cystic fibrosis.

The method of embodiment 9, further comprising the administration of an additional treatment.

The method of embodiment 9, wherein the additional treatment is a composition.

The method of embodiment 9, wherein the additional treatment is a method.

The method of embodiment 9, wherein the additional treatment and the RNAi agent can be administered in any order.

A medicament for use in an RNAi formulation comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-ENaC provided in Table 1.

A composition of embodiment 10 is a composition comprising a RNAi agent comprising a first strand and a second strand, wherein the sequence of the first strand comprises the sequence of the first strand of a RNAi agent specific to Beta-ENaC provided in Table 1.

The composition of embodiment 10, wherein the composition comprises a second RNAi agent to Beta-ENaC.

The composition of embodiment 10, wherein the second strand is 30 or fewer nucleotides in length.

The composition of embodiment 10, wherein the first strand and the second strand form a duplex region 15 to 30 nucleotide pairs in length.

The composition of embodiment 10, wherein the first strand and the second strand are independently 19 to 23 nucleotides in length.

The composition of embodiment 10, wherein the RNAi agent comprises a modification that causes the RNAi agent to have increased stability in a biological sample or environment.

The composition of embodiment 10, wherein the RNAi agent comprises a phosphorothioate and/or a 2'-modified nucleotide.

The composition of embodiment 10, wherein the RNAi agent comprises:
at least one 5'-uridine-adenine-3' (5'-ua-3') dinucleotide, wherein the uridine is a 2'-modified nucleotide; and/or at least one 5'-uridine-guanine-3' (5'-ug-3') dinucleotide, wherein the 5'-uridine is a 2'-modified nucleotide;
and/or at least one 5'-cytidine-adenine-3' (5'-ca-3') dinucleotide, wherein the 5'-cytidine is a 2'-modified nucleotide;
and/or at least one 5'-uridine-uridine-3' (5'-uu-3') dinucleotide, wherein the 5'-uridine is a 2'-modified nucleotide.

The composition of embodiment 10, wherein the RNAi agent comprises one or more 2'-modifications selected from the group consisting of:
2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-0-DMAP), 2'-O-dimethylaminoethyloxyethyl (2'-O-DMAEOE), and 2'-O—N-methylacetamido (2'-O-NMA).

The composition of embodiment 10, wherein the RNAi agent comprises a blunt end.

The composition of embodiment 10, wherein the RNAi agent comprises an overhang having 1 to 4 unpaired nucleotides.

The composition of embodiment 10, wherein the RNAi agent comprises an overhang at the 3'-end of the antisense strand.

The composition of embodiment 10, wherein the RNAi agent is ligated to one or more agents, the agent selected from a: diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

The composition of embodiment 10, wherein the RNAi agent is capable of inhibiting expression of the Beta-ENaC gene by at least about 60% at a concentration of 10 nM in H441 cells in vitro.

The composition of embodiment 10, wherein the RNAi agent is capable of inhibiting expression of the Beta-ENaC gene by at least about 70% at a concentration of 10 nM in H441 cells in vitro.

The composition of embodiment 10, wherein the RNAi agent is capable of inhibiting expression of the Beta-ENaC gene by at least about 80% at a concentration of 10 nM in H441 cells in vitro.

The composition of embodiment 10, wherein the RNAi agent is capable of inhibiting expression of the Beta-ENaC gene by at least about 90% at a concentration of 10 nM in H441 cells in vitro.

The composition of embodiment 10, wherein the RNAi has an EC50 of no more than about 0.1 nM.

The composition of embodiment 10, wherein the RNAi has an EC50 of no more than about 0.01 nM.

The composition of embodiment 10, wherein the RNAi has an EC50 of no more than about 0.001 nM.

A composition of embodiment 11 is a composition comprising a RNAi agent comprising a first strand and a second strand, wherein the sequence of the first strand is the sequence of the first strand of a RNAi agent specific to Beta-ENaC provided in Table 1.

The composition of embodiment 11, wherein the composition comprises a second RNAi agent to Beta-ENaC.

The composition of embodiment 11, wherein the second strand is 30 or fewer nucleotides in length.

The composition of embodiment 11, wherein the first strand and the second strand form a duplex region 15 to 30 nucleotide pairs in length.

The composition of embodiment 11, wherein the first strand and the second strand are independently 19 to 23 nucleotides in length.

The composition of embodiment 11, wherein the RNAi agent comprises a modification that causes the RNAi agent to have increased stability in a biological sample or environment.

The composition of embodiment 11, wherein the RNAi agent comprises a phosphorothioate and/or a 2'-modified nucleotide.

The composition of embodiment 11, wherein the RNAi agent comprises:

at least one 5'-uridine-adenine-3' (5'-ua-3') dinucleotide, wherein the uridine is a 2'-modified nucleotide; and/or at least one 5'-uridine-guanine-3' (5'-ug-3') dinucleotide, wherein the 5'-uridine is a 2'-modified nucleotide;

and/or at least one 5'-cytidine-adenine-3' (5'-ca-3') dinucleotide, wherein the 5'-cytidine is a 2'-modified nucleotide;

and/or at least one 5'-uridine-uridine-3' (5'-uu-3') dinucleotide, wherein the 5'-uridine is a 2'-modified nucleotide.

The composition of embodiment 11, wherein the RNAi agent comprises one or more 2'-modifications selected from the group consisting of:

2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-0-DMAP), 2'-O-dimethylaminoethyloxyethyl (2'-O-DMAEOE), and 2'-O—N-methylacetamido (2'-O-NMA).

The composition of embodiment 11, wherein the RNAi agent comprises a blunt end.

The composition of embodiment 11, wherein the RNAi agent comprises an overhang having 1 to 4 unpaired nucleotides.

The composition of embodiment 11, wherein the RNAi agent comprises an overhang at the 3'-end of the antisense strand.

The composition of embodiment 11, wherein the RNAi agent is ligated to one or more agents, the agent selected from a: diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

The composition of embodiment 11, wherein the RNAi agent is capable of inhibiting expression of the Beta-ENaC gene by at least about 60% at a concentration of 10 nM in H441 cells in vitro.

The composition of embodiment 11, wherein the RNAi agent is capable of inhibiting expression of the Beta-ENaC gene by at least about 70% at a concentration of 10 nM in H441 cells in vitro.

The composition of embodiment 11, wherein the RNAi agent is capable of inhibiting expression of the Beta-ENaC gene by at least about 80% at a concentration of 10 nM in H441 cells in vitro.

The composition of embodiment 11, wherein the RNAi agent is capable of inhibiting expression of the Beta-ENaC gene by at least about 90% at a concentration of 10 nM in H441 cells in vitro.

The composition of embodiment 11, wherein the RNAi has an EC50 of no more than about 0.1 nM.

The composition of embodiment 11, wherein the RNAi has an EC50 of no more than about 0.01 nM.

The composition of embodiment 11, wherein the RNAi has an EC50 of no more than about 0.001 nM.

A composition of embodiment 12 is any composition above in a pharmaceutically effective formulation.

The composition according to embodiment 12, for use in a method of treating a Beta-ENaC-related disease in an individual, the method comprising the step of administering to the individual a therapeutically effective amount of a composition comprising a RNAi agent comprising a sense strand and an antisense strand, wherein the antisense strand comprises at least 15 contiguous nucleotides differing by 0, 1, 2, or 3 nucleotides from the antisense strand of a RNAi agent specific to Beta-ENaC provided in Table 1.

The use of a composition according to embodiment 12, in the manufacture of a medicament for the treatment of a Beta-ENaC-related disease.

The use of a composition according to embodiment 12, wherein the Beta-ENaC-related disease is cystic fibrosis, pseudohypoaldosteronism type 1 (PHA1), Liddle's syndrome, hypertension, alkalosis, hypokalemia, and/or obesity-associated hypertension.

The composition of embodiment 12, wherein all the pyrimidines are 2' O-methyl-modified nucleotides.

The composition of embodiment 12, wherein all the pyrimidines are 2' O-methyl-modified nucleotides.

Unless defined otherwise, the technical and scientific terms used herein have the same meaning as that usually understood by a specialist familiar with the field to which the disclosure belongs.

Unless indicated otherwise, all methods, steps, techniques and manipulations that are not specifically described in detail can be performed and have been performed in a manner known per se, as will be clear to the skilled person.

Reference is for example again made to the standard handbooks and the general background art mentioned herein and to the further references cited therein. Unless indicated otherwise, each of the references cited herein is incorporated in its entirety by reference.

Claims to the invention are non-limiting and are provided below.

Although particular embodiments and claims have been disclosed herein in detail, this has been done by way of example for purposes of illustration only, and is not intended to be limiting with respect to the scope of the appended claims, or the scope of subject matter of claims of any corresponding future application. In particular, it is contemplated by the inventors that various substitutions, alterations, and modifications may be made to the disclosure without departing from the spirit and scope of the disclosure as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims. Those skilled in the art will recognize or be able to ascertain, using no more than routine experimentation, many equivalents of the specific embodiments of the invention described herein. Such equivalents are intended to be encompassed by the following claims. Redrafting of claim scope in later filed corresponding applications may be due to limitations by the patent laws of various countries and should not be interpreted as giving up subject matter of the claims.

SEQUENCE LISTING (6497 sequences)

SEQ ID NO: 1 - RNA, 19 nt, Artificial Sequence
  source: /note="Description of Artificial Sequence: Synthetic oligonucleotide"
uggugcugacuauccaguu

SEQ ID NO: 2 - RNA, 19 nt, Artificial Sequence
  source: /note="Description of Artificial Sequence: Synthetic oligonucleotide"
ccaucugugcucuucguca

SEQ ID NO: 3 - RNA, 19 nt, Artificial Sequence
  source: /note="Description of Artificial Sequence: Synthetic oligonucleotide"
auaagcagguggaucuauu

SEQ ID NO: 4 - RNA, 19 nt, Artificial Sequence
  source: /note="Description of Artificial Sequence: Synthetic oligonucleotide"
auccaaagaguagcugcag

SEQ ID NO: 5 - RNA, 19 nt, Artificial Sequence
  source: /note="Description of Artificial Sequence: Synthetic oligonucleotide"
gacaauggcuacucaagcu

SEQ ID NO: 6 - RNA, 19 nt, Artificial Sequence
  source: /note="Description of Artificial Sequence: Synthetic oligonucleotide"
cuguuggauugauucgaaa

SEQ ID NO: 7 - RNA, 19 nt, Artificial Sequence
  source: /note="Description of Artificial Sequence: Synthetic oligonucleotide"
gcuggccugguuugauacu

SEQ ID NO: 8 - RNA, 19 nt, Artificial Sequence
  source: /note="Description of Artificial Sequence: Synthetic oligonucleotide"
ucuaaccucacuugcaaua

SEQ ID NO: 9 - RNA, 19 nt, Artificial Sequence
  source: /note="Description of Artificial Sequence: Synthetic oligonucleotide"
gauaucgccaggaugaucc

SEQ ID NO: 10 - RNA, 19 nt, Artificial Sequence
  source: /note="Description of Artificial Sequence: Synthetic oligonucleotide"
uggccaucuuuaagucugg

SEQ ID NO: 11 - RNA, 19 nt, Artificial Sequence
  source: /note="Description of Artificial Sequence: Synthetic oligonucleotide"
uguagaacacuaauucaua

SEQ ID NO: 12 - RNA, 19 nt, Artificial Sequence
  source: /note="Description of Artificial Sequence: Synthetic oligonucleotide"
aucaguaagagguguuauu

SEQ ID NO: 13 - RNA, 19 nt, Artificial Sequence
  source: /note="Description of Artificial Sequence: Synthetic oligonucleotide"
gugcucuucgucaucugac

SEQ ID NO: 14 - RNA, 19 nt, Artificial Sequence
  source: /note="Description of Artificial Sequence: Synthetic oligonucleotide"
ugguuugauacugaccugu

SEQ ID NO: 15 - RNA, 19 nt, Artificial Sequence
  source: /note="Description of Artificial Sequence: Synthetic oligonucleotide"
ccaguugccuuuuauccca

SEQ ID NO: 16 - RNA, 19 nt, Artificial Sequence
  source: /note="Description of Artificial Sequence: Synthetic oligonucleotide"
ccugguuugauacugaccu

SEQ ID NO: 17 - RNA, 19 nt, Artificial Sequence
  source: /note="Description of Artificial Sequence: Synthetic oligonucleotide"
gacuauccaguugaugggc

SEQ ID NO: 18 - RNA, 19 nt, Artificial Sequence
  source: /note="Description of Artificial Sequence: Synthetic oligonucleotide"
agccaauggcuuggaauga

SEQ ID NO: 19 - RNA, 19 nt, Artificial Sequence
  source: /note="Description of Artificial Sequence: Synthetic oligonucleotide"
gccaauggcuuggaaugag

SEQ ID NO: 20 - RNA, 19 nt, Artificial Sequence
  source: /note="Description of Artificial Sequence: Synthetic oligonucleotide"
agaugagggcaugcagauc

SEQ ID NO: 21 - RNA, 19 nt, Artificial Sequence
  source: /note="Description of Artificial Sequence: Synthetic oligonucleotide"
gguccucugugaacuugcu

SEQ ID NO: 22 - RNA, 19 nt, Artificial Sequence
  source: /note="Description of Artificial Sequence: Synthetic oligonucleotide"
aacccuagccuugcuuguu

SEQ ID NO: 23 - RNA, 19 nt, Artificial Sequence
  source: /note="Description of Artificial Sequence: Synthetic oligonucleotide"
gaacacuaauucauaauca

SEQ ID NO: 24 - RNA, 19 nt, Artificial Sequence
  source: /note="Description of Artificial Sequence: Synthetic oligonucleotide"
aucaaacccuagccuugcu

SEQ ID NO: 25 - RNA, 19 nt, Artificial Sequence
  source: /note="Description of Artificial Sequence: Synthetic oligonucleotide"
accaguugccuuuuauccc

SEQ ID NO: 26 - RNA, 19 nt, Artificial Sequence
  source: /note="Description of Artificial Sequence: Synthetic oligonucleotide"
cuaaccucacuugcaauaa

SEQ ID NO: 27 - RNA, 19 nt, Artificial Sequence
  source: /note="Description of Artificial Sequence: Synthetic oligonucleotide"
aucccacuaauguccagcg

SEQ ID NO: 28 - RNA, 19 nt, Artificial Sequence
  source: /note="Description of Artificial Sequence: Synthetic oligonucleotide"
cugacuauccaguugaugg

SEQ ID NO: 29 - RNA, 19 nt, Artificial Sequence
  source: /note="Description of Artificial Sequence: Synthetic oligonucleotide"
ggccugguuugauacugac

SEQ ID NO: 30 - RNA, 19 nt, Artificial Sequence
  source: /note="Description of Artificial Sequence: Synthetic oligonucleotide"
gguaaaucaguaagaggug

SEQ ID NO: 31 - RNA, 19 nt, Artificial Sequence
  source: /note="Description of Artificial Sequence: Synthetic oligonucleotide"
gccugguuugauacugacc

SEQ ID NO: 32 - RNA, 19 nt, Artificial Sequence
  source: /note="Description of Artificial Sequence: Synthetic oligonucleotide"
cagggguccucugugaacu

SEQ ID NO: 33 - RNA, 19 nt, Artificial Sequence
  source: /note="Description of Artificial Sequence: Synthetic oligonucleotide"
cuggaauccauucuggugc

SEQ ID NO: 34 - RNA, 19 nt, Artificial Sequence
  source: /note="Description of Artificial Sequence: Synthetic oligonucleotide"
ugagauggguggccaccac

SEQ ID NO: 35 - RNA, 19 nt, Artificial Sequence
  source: /note="Description of Artificial Sequence: Synthetic oligonucleotide"
gaugauauaaaugugguca

SEQ ID NO: 36 - RNA, 19 nt, Artificial Sequence
  source: /note="Description of Artificial Sequence: Synthetic oligonucleotide"
ugcuuuauucucccauuga

SEQ ID NO: 37 - RNA, 19 nt, Artificial Sequence
  source: /note="Description of Artificial Sequence: Synthetic oligonucleotide"
uuaucaaacccuagccuug

SEQ ID NO: 38 - RNA, 19 nt, Artificial Sequence
  source: /note="Description of Artificial Sequence: Synthetic oligonucleotide"
ccacuggccucugauaaag

SEQ ID NO: 39 - RNA, 19 nt, Artificial Sequence
  source: /note="Description of Artificial Sequence: Synthetic oligonucleotide"
aacuugccacacgugcaau

SEQ ID NO: 40 - RNA, 19 nt, Artificial Sequence
  source: /note="Description of Artificial Sequence: Synthetic oligonucleotide"
gcucuucgucaucugacca

SEQ ID NO: 41 - RNA, 19 nt, Artificial Sequence
  source: /note="Description of Artificial Sequence: Synthetic oligonucleotide"
guaacaauacaaauggauu

SEQ ID NO: 42 - RNA, 19 nt, Artificial Sequence
  source: /note="Description of Artificial Sequence: Synthetic oligonucleotide"
gggguccucugugaacuug

SEQ ID NO: 43 - RNA, 19 nt, Artificial Sequence
  source: /note="Description of Artificial Sequence: Synthetic oligonucleotide"
caaacccuagccuugcuug

SEQ ID NO: 44 - RNA, 19 nt, Artificial Sequence
  source: /note="Description of Artificial Sequence: Synthetic oligonucleotide"
gaguaaugguguagaacac

SEQ ID NO: 45 - RNA, 19 nt, Artificial Sequence
  source: /note="Description of Artificial Sequence: Synthetic oligonucleotide"
ggaagacaucacugagccu

SEQ ID NO: 46 - RNA, 19 nt, Artificial Sequence
  source: /note="Description of Artificial Sequence: Synthetic oligonucleotide"
gggaagacaucacugagcc

SEQ ID NO: 47 - RNA, 19 nt, Artificial Sequence
  source: /note="Description of Artificial Sequence: Synthetic oligonucleotide"
gguguagaacacuaauuca

SEQ ID NO: 48 - RNA, 19 nt, Artificial Sequence
  source: /note="Description of Artificial Sequence: Synthetic oligonucleotide"
uaccaguugccuuuuaucc

SEQ ID NO: 49 - RNA, 19 nt, Artificial Sequence
  source: /note="Description of Artificial Sequence: Synthetic oligonucleotide"
ggauaucgccaggaugauc

SEQ ID NO: 50 - RNA, 19 nt, Artificial Sequence
  source: /note="Description of Artificial Sequence: Synthetic oligonucleotide"
aaacccuagccuugcuugu

SEQ ID NO: 51 - RNA, 19 nt, Artificial Sequence
  source: /note="Description of Artificial Sequence: Synthetic oligonucleotide"
cucuucgucaucugaccag

SEQ ID NO: 52 - RNA, 19 nt, Artificial Sequence
  source: /note="Description of Artificial Sequence: Synthetic oligonucleotide"
ugacuauccaguugauggg

SEQ ID NO: 53 - RNA, 19 nt, Artificial Sequence
  source: /note="Description of Artificial Sequence: Synthetic oligonucleotide"
acaagcagagugcugaagg

SEQ ID NO: 54 - RNA, 19 nt, Artificial Sequence
  source: /note="Description of Artificial Sequence: Synthetic oligonucleotide"
caucugugcucuucgucau

SEQ ID NO: 55 - RNA, 19 nt, Artificial Sequence
  source: /note="Description of Artificial Sequence: Synthetic oligonucleotide"
caauggcuuggaaugagac

SEQ ID NO: 56 - RNA, 19 nt, Artificial Sequence
  source: /note="Description of Artificial Sequence: Synthetic oligonucleotide"
acuggccucugauaaaggc

SEQ ID NO: 57 - RNA, 19 nt, Artificial Sequence
  source: /note="Description of Artificial Sequence: Synthetic oligonucleotide"
ucaucccacuaauguccag

SEQ ID NO: 58 - RNA, 19 nt, Artificial Sequence
  source: /note="Description of Artificial Sequence: Synthetic oligonucleotide"
aaaaggaagcuuccagaca

SEQ ID NO: 59 - RNA, 19 nt, Artificial Sequence
  source: /note="Description of Artificial Sequence: Synthetic oligonucleotide"
cguucuuuucacucuggug

SEQ ID NO: 60 - RNA, 19 nt, Artificial Sequence
  source: /note="Description of Artificial Sequence: Synthetic oligonucleotide"
aaaguuguuguaaccugcu

SEQ ID NO: 61 - RNA, 19 nt, Artificial Sequence
  source: /note="Description of Artificial Sequence: Synthetic oligonucleotide"
acaauggcuacucaagcug

SEQ ID NO: 62 - RNA, 19 nt, Artificial Sequence
  source: /note="Description of Artificial Sequence: Synthetic oligonucleotide"
cucaucccacuaaugucca

SEQ ID NO: 63 - RNA, 19 nt, Artificial Sequence
  source: /note="Description of Artificial Sequence: Synthetic oligonucleotide"
agggguccucugugaacuu

SEQ ID NO: 64 - RNA, 19 nt, Artificial Sequence
  source: /note="Description of Artificial Sequence: Synthetic oligonucleotide"
aagcagguggaucuauuuc

SEQ ID NO: 65 - RNA, 19 nt, Artificial Sequence
  source: /note="Description of Artificial Sequence: Synthetic oligonucleotide"
aaguuguuguaaccugcug

SEQ ID NO: 66 - RNA, 19 nt, Artificial Sequence
  source: /note="Description of Artificial Sequence: Synthetic oligonucleotide"
agcagguggaucuauuuca

SEQ ID NO: 67 - RNA, 19 nt, Artificial Sequence
  source: /note="Description of Artificial Sequence: Synthetic oligonucleotide"
agggcaugcagaucccauc

SEQ ID NO: 68 - RNA, 19 nt, Artificial Sequence
  source: /note="Description of Artificial Sequence: Synthetic oligonucleotide"
aaaugguucagaauuaaac

SEQ ID NO: 69 - RNA, 19 nt, Artificial Sequence
  source: /note="Description of Artificial Sequence: Synthetic oligonucleotide"
ugaacuugcucaggacaag

SEQ ID NO: 70 - RNA, 19 nt, Artificial Sequence
  source: /note="Description of Artificial Sequence: Synthetic oligonucleotide"
aagaguagcugcagggguc

SEQ ID NO: 71 - RNA, 19 nt, Artificial Sequence
  source: /note="Description of Artificial Sequence: Synthetic oligonucleotide"
cccacuggccucugauaaa

SEQ ID NO: 72 - RNA, 19 nt, Artificial Sequence
  source: /note="Description of Artificial Sequence: Synthetic oligonucleotide"
cuggccugguuugauacug

SEQ ID NO: 73 - RNA, 19 nt, Artificial Sequence
  source: /note="Description of Artificial Sequence: Synthetic oligonucleotide"
uugauacugaccuguaaau

SEQ ID NO: 74 - RNA, 19 nt, Artificial Sequence
  source: /note="Description of Artificial Sequence: Synthetic oligonucleotide"
guguagaacacuaauucau

SEQ ID NO: 75 - RNA, 19 nt, Artificial Sequence
  source: /note="Description of Artificial Sequence: Synthetic oligonucleotide"
acuauccaguugaugggcu

SEQ ID NO: 76 - RNA, 19 nt, Artificial Sequence
  source: /note="Description of Artificial Sequence: Synthetic oligonucleotide"
aaaucaguaagagguguua

SEQ ID NO: 77 - RNA, 19 nt, Artificial Sequence
  source: /note="Description of Artificial Sequence: Synthetic oligonucleotide"
gcagguggaucuauuucau

SEQ ID NO: 78 - RNA, 19 nt, Artificial Sequence
  source: /note="Description of Artificial Sequence: Synthetic oligonucleotide"
cuggugcugacuauccagu

SEQ ID NO: 79 - RNA, 19 nt, Artificial Sequence
  source: /note="Description of Artificial Sequence: Synthetic oligonucleotide"
gugaacuugcucaggacaa

SEQ ID NO: 80 - RNA, 19 nt, Artificial Sequence
  source: /note="Description of Artificial Sequence: Synthetic oligonucleotide"
ucaguaagagguguuauuu

SEQ ID NO: 81 - RNA, 19 nt, Artificial Sequence
  source: /note="Description of Artificial Sequence: Synthetic oligonucleotide"
ccucugugaacuugcucag

SEQ ID NO: 82 - RNA, 19 nt, Artificial Sequence
  source: /note="Description of Artificial Sequence: Synthetic oligonucleotide"
uuggcugaaccaucacaga

SEQ ID NO: 83 - RNA, 19 nt, Artificial Sequence
  source: /note="Description of Artificial Sequence: Synthetic oligonucleotide"
ucagcuggccugguuugau

SEQ ID NO: 84 - RNA, 19 nt, Artificial Sequence
  source: /note="Description of Artificial Sequence: Synthetic oligonucleotide"
guagcugcagggguccucu

SEQ ID NO: 85 - RNA, 19 nt, Artificial Sequence
  source: /note="Description of Artificial Sequence: Synthetic oligonucleotide"
aggagcuaaaauggcagug

SEQ ID NO: 86 - RNA, 19 nt, Artificial Sequence
  source: /note="Description of Artificial Sequence: Synthetic oligonucleotide"
auggcuuggaaugagacug

SEQ ID NO: 87 - RNA, 19 nt, Artificial Sequence
  source: /note="Description of Artificial Sequence: Synthetic oligonucleotide"
uuggauaucgccaggauga

SEQ ID NO: 88 - RNA, 19 nt, Artificial Sequence
  source: /note="Description of Artificial Sequence: Synthetic oligonucleotide"
gguucagaauuaaacuuuu

SEQ ID NO: 89 - RNA, 19 nt, Artificial Sequence
  source: /note="Description of Artificial Sequence: Synthetic oligonucleotide"
ggguaaaucaguaagaggu

SEQ ID NO: 90 - RNA, 19 nt, Artificial Sequence
  source: /note="Description of Artificial Sequence: Synthetic oligonucleotide"
auaccauuccauuguuugu

SEQ ID NO: 91 - RNA, 19 nt, Artificial Sequence
  source: /note="Description of Artificial Sequence: Synthetic oligonucleotide"
acuguuggauugauucgaa

SEQ ID NO: 92 - RNA, 19 nt, Artificial Sequence
  source: /note="Description of Artificial Sequence: Synthetic oligonucleotide"
aacuugcucaggacaagga

SEQ ID NO: 93 - RNA, 19 nt, Artificial Sequence
  source: /note="Description of Artificial Sequence: Synthetic oligonucleotide"
augcuuaaaauaagcaggu

SEQ ID NO: 94 - RNA, 19 nt, Artificial Sequence
  source: /note="Description of Artificial Sequence: Synthetic oligonucleotide"
guuugauacugaccuguaa

SEQ ID NO: 95 - RNA, 19 nt, Artificial Sequence
  source: /note="Description of Artificial Sequence: Synthetic oligonucleotide"
aaugguucagaauuaaacu

SEQ ID NO: 96 - RNA, 19 nt, Artificial Sequence
  source: /note="Description of Artificial Sequence: Synthetic oligonucleotide"
uaucccaaaguuguuguaa

SEQ ID NO: 97 - RNA, 19 nt, Artificial Sequence
  source: /note="Description of Artificial Sequence: Synthetic oligonucleotide"
aucagcuggccugguuuga

SEQ ID NO: 98 - RNA, 19 nt, Artificial Sequence
  source: /note="Description of Artificial Sequence: Synthetic oligonucleotide"
ccugccaucugugcucuuc

SEQ ID NO: 99 - RNA, 19 nt, Artificial Sequence
  source: /note="Description of Artificial Sequence: Synthetic oligonucleotide"
gcagaauacaaaugaugua

SEQ ID NO: 100 - RNA, 19 nt, Artificial Sequence
  source: /note="Description of Artificial Sequence: Synthetic oligonucleotide"
uaugcuuaaaauaagcagg

SEQ ID NO: 101 - RNA, 19 nt, Artificial Sequence
  source: /note="Description of Artificial Sequence: Synthetic oligonucleotide"
aauaagcagguggaucuau

SEQ ID NO: 102 - RNA, 19 nt, Artificial Sequence
  source: /note="Description of Artificial Sequence: Synthetic oligonucleotide"
ugauauaaauguggucacc

SEQ ID NO: 103 - RNA, 19 nt, Artificial Sequence
  source: /note="Description of Artificial Sequence: Synthetic oligonucleotide"
guaggguaaaucaguaaga

SEQ ID NO: 104 - RNA, 19 nt, Artificial Sequence
  source: /note="Description of Artificial Sequence: Synthetic oligonucleotide"
uaucaaacccuagccuugc

SEQ ID NO: 105 - RNA, 19 nt, Artificial Sequence
  source: /note="Description of Artificial Sequence: Synthetic oligonucleotide"
ccuuuuaucccaaaguugu

SEQ ID NO: 106 - RNA, 19 nt, Artificial Sequence
  source: /note="Description of Artificial Sequence: Synthetic oligonucleotide"
gguaggguaaaucaguaag

SEQ ID NO: 107 - RNA, 19 nt, Artificial Sequence
  source: /note="Description of Artificial Sequence: Synthetic oligonucleotide"
ugauacugaccuguaaauc

SEQ ID NO: 108 - RNA, 19 nt, Artificial Sequence
  source: /note="Description of Artificial Sequence: Synthetic oligonucleotide"
ggcugaaccaucacagaug

SEQ ID NO: 109 - RNA, 19 nt, Artificial Sequence
  source: /note="Description of Artificial Sequence: Synthetic oligonucleotide"
uggauaucgccaggaugau

SEQ ID NO: 110 - RNA, 19 nt, Artificial Sequence
  source: /note="Description of Artificial Sequence: Synthetic oligonucleotide"
ucuucgucaucugaccagc

SEQ ID NO: 111 - RNA, 19 nt, Artificial Sequence
  source: /note="Description of Artificial Sequence: Synthetic oligonucleotide"
uagcugcagggguccucug

SEQ ID NO: 112 - RNA, 19 nt, Artificial Sequence
  source: /note="Description of Artificial Sequence: Synthetic oligonucleotide"
uguuguaaccugcugugau

SEQ ID NO: 113 - RNA, 19 nt, Artificial Sequence
  source: /note="Description of Artificial Sequence: Synthetic oligonucleotide"
aaucaguaagagguguuau

SEQ ID NO: 114 - RNA, 19 nt, Artificial Sequence
  source: /note="Description of Artificial Sequence: Synthetic oligonucleotide"
uggcugaaccaucacagau

SEQ ID NO: 115 - RNA, 19 nt, Artificial Sequence
  source: /note="Description of Artificial Sequence: Synthetic oligonucleotide"
gaauuaaacuuuuaauuca

SEQ ID NO: 116 - RNA, 19 nt, Artificial Sequence
  source: /note="Description of Artificial Sequence: Synthetic oligonucleotide"
augguucagaauuaaacuu

SEQ ID NO: 117 - RNA, 19 nt, Artificial Sequence
  source: /note="Description of Artificial Sequence: Synthetic oligonucleotide"
ugguguagaacacuaauuc

SEQ ID NO: 118 - RNA, 19 nt, Artificial Sequence
  source: /note="Description of Artificial Sequence: Synthetic oligonucleotide"
augguguagaacacuaauu

SEQ ID NO: 119 - RNA, 19 nt, Artificial Sequence
  source: /note="Description of Artificial Sequence: Synthetic oligonucleotide"
augagggcaugcagauccc

SEQ ID NO: 120 - RNA, 19 nt, Artificial Sequence
  source: /note="Description of Artificial Sequence: Synthetic oligonucleotide"
guuguaaccugcugugaua

SEQ ID NO: 121 - RNA, 19 nt, Artificial Sequence
  source: /note="Description of Artificial Sequence: Synthetic oligonucleotide"
gcugacuauccaguugaug

SEQ ID NO: 122 - RNA, 19 nt, Artificial Sequence
  source: /note="Description of Artificial Sequence: Synthetic oligonucleotide"
uaagcagguggaucuauuu

SEQ ID NO: 123 - RNA, 19 nt, Artificial Sequence
  source: /note="Description of Artificial Sequence: Synthetic oligonucleotide"
uaaaauaagcagguggauc

SEQ ID NO: 124 - RNA, 19 nt, Artificial Sequence
  source: /note="Description of Artificial Sequence: Synthetic oligonucleotide"
gauauaaauguggucaccu

SEQ ID NO: 125 - RNA, 19 nt, Artificial Sequence
  source: /note="Description of Artificial Sequence: Synthetic oligonucleotide"
aagcagagugcugaaggug

SEQ ID NO: 126 - RNA, 19 nt, Artificial Sequence
  source: /note="Description of Artificial Sequence: Synthetic oligonucleotide"
ugugaacuugcucaggaca

SEQ ID NO: 127 - RNA, 19 nt, Artificial Sequence
  source: /note="Description of Artificial Sequence: Synthetic oligonucleotide"
caucccacuaauguccagc

SEQ ID NO: 128 - RNA, 19 nt, Artificial Sequence
  source: /note="Description of Artificial Sequence: Synthetic oligonucleotide"
caaaguuguuguaaccugc

SEQ ID NO: 129 - RNA, 19 nt, Artificial Sequence
  source: /note="Description of Artificial Sequence: Synthetic oligonucleotide"
uaaaucaguaagagguguu

SEQ ID NO: 130 - RNA, 19 nt, Artificial Sequence
  source: /note="Description of Artificial Sequence: Synthetic oligonucleotide"
aauggcuuggaaugagacu

SEQ ID NO: 131 - RNA, 19 nt, Artificial Sequence
  source: /note="Description of Artificial Sequence: Synthetic oligonucleotide"
ggguccucugugaacuugc

SEQ ID NO: 132 - RNA, 19 nt, Artificial Sequence
  source: /note="Description of Artificial Sequence: Synthetic oligonucleotide"
gaguaacaauacaaaugga

SEQ ID NO: 133 - RNA, 19 nt, Artificial Sequence
  source: /note="Description of Artificial Sequence: Synthetic oligonucleotide"
uaaugguguagaacacuaa

SEQ ID NO: 134 - RNA, 19 nt, Artificial Sequence
  source: /note="Description of Artificial Sequence: Synthetic oligonucleotide"
guggacaauggcuacucaa

SEQ ID NO: 135 - RNA, 19 nt, Artificial Sequence
  source: /note="Description of Artificial Sequence: Synthetic oligonucleotide"
aacugucuuuggacucuca

SEQ ID NO: 136 - RNA, 19 nt, Artificial Sequence
  source: /note="Description of Artificial Sequence: Synthetic oligonucleotide"
cccuggugcugacuaucca

SEQ ID NO: 137 - RNA, 19 nt, Artificial Sequence
  source: /note="Description of Artificial Sequence: Synthetic oligonucleotide"
cagguggaucuauuucaug

SEQ ID NO: 138 - RNA, 19 nt, Artificial Sequence
  source: /note="Description of Artificial Sequence: Synthetic oligonucleotide"
uggccugguuugauacuga

SEQ ID NO: 139 - RNA, 19 nt, Artificial Sequence
  source: /note="Description of Artificial Sequence: Synthetic oligonucleotide"
agcuggccugguuugauac

SEQ ID NO: 140 - RNA, 19 nt, Artificial Sequence
  source: /note="Description of Artificial Sequence: Synthetic oligonucleotide"
gccaucugugcucuucguc

SEQ ID NO: 141 - RNA, 19 nt, Artificial Sequence
  source: /note="Description of Artificial Sequence: Synthetic oligonucleotide"
uaccauuccauuguuugug

SEQ ID NO: 142 - RNA, 19 nt, Artificial Sequence
  source: /note="Description of Artificial Sequence: Synthetic oligonucleotide"
cccuuggauaucgccagga

SEQ ID NO: 143 - RNA, 19 nt, Artificial Sequence
  source: /note="Description of Artificial Sequence: Synthetic oligonucleotide"
agggaagacaucacugagc

SEQ ID NO: 144 - RNA, 19 nt, Artificial Sequence
  source: /note="Description of Artificial Sequence: Synthetic oligonucleotide"
gaacuugccacacgugcaa

SEQ ID NO: 145 - RNA, 19 nt, Artificial Sequence
  source: /note="Description of Artificial Sequence: Synthetic oligonucleotide"
uuugauacugaccuguaaa

SEQ ID NO: 146 - RNA, 19 nt, Artificial Sequence
  source: /note="Description of Artificial Sequence: Synthetic oligonucleotide"
ucccaaaguuguuguaacc

SEQ ID NO: 147 - RNA, 19 nt, Artificial Sequence
  source: /note="Description of Artificial Sequence: Synthetic oligonucleotide"
cagaauacaaaugauguag

SEQ ID NO: 148 - RNA, 19 nt, Artificial Sequence
  source: /note="Description of Artificial Sequence: Synthetic oligonucleotide"
agguggaucuauuucaugu

SEQ ID NO: 149 - RNA, 19 nt, Artificial Sequence
  source: /note="Description of Artificial Sequence: Synthetic oligonucleotide"
gcucaucccacuaaugucc

SEQ ID NO: 150 - RNA, 19 nt, Artificial Sequence
  source: /note="Description of Artificial Sequence: Synthetic oligonucleotide"
ccuggugcugacuauccag

SEQ ID NO: 151 - RNA, 19 nt, Artificial Sequence
  source: /note="Description of Artificial Sequence: Synthetic oligonucleotide"
uggaauccauucuggugcc

SEQ ID NO: 152 - RNA, 19 nt, Artificial Sequence
  source: /note="Description of Artificial Sequence: Synthetic oligonucleotide"
ccaggaccucauggauggg

SEQ ID NO: 153 - RNA, 19 nt, Artificial Sequence
  source: /note="Description of Artificial Sequence: Synthetic oligonucleotide"
aaccucacuugcaauaauu

SEQ ID NO: 154 - RNA, 19 nt, Artificial Sequence
  source: /note="Description of Artificial Sequence: Synthetic oligonucleotide"
caguugccuuuuaucccaa

SEQ ID NO: 155 - RNA, 19 nt, Artificial Sequence
  source: /note="Description of Artificial Sequence: Synthetic oligonucleotide"
guagaacacuaauucauaa

SEQ ID NO: 156 - RNA, 19 nt, Artificial Sequence
  source: /note="Description of Artificial Sequence: Synthetic oligonucleotide"
cuauccaguugaugggcug

SEQ ID NO: 157 - RNA, 19 nt, Artificial Sequence
  source: /note="Description of Artificial Sequence: Synthetic oligonucleotide"
cacuggccucugauaaagg

SEQ ID NO: 158 - RNA, 19 nt, Artificial Sequence
  source: /note="Description of Artificial Sequence: Synthetic oligonucleotide"
acugucuuuggacucucag

SEQ ID NO: 159 - RNA, 19 nt, Artificial Sequence
  source: /note="Description of Artificial Sequence: Synthetic oligonucleotide"
ccaauggcuuggaaugaga

SEQ ID NO: 160 - RNA, 19 nt, Artificial Sequence
  source: /note="Description of Artificial Sequence: Synthetic oligonucleotide"
gcuuaaaauaagcaggugg

SEQ ID NO: 161 - RNA, 19 nt, Artificial Sequence
  source: /note="Description of Artificial Sequence: Synthetic oligonucleotide"
aucugugcucuucgucauc

SEQ ID NO: 162 - RNA, 19 nt, Artificial Sequence
  source: /note="Description of Artificial Sequence: Synthetic oligonucleotide"
cccaaaguuguuguaaccu

SEQ ID NO: 163 - RNA, 19 nt, Artificial Sequence
  source: /note="Description of Artificial Sequence: Synthetic oligonucleotide"
uacccagcgccguacgucc

SEQ ID NO: 164 - RNA, 19 nt, Artificial Sequence
  source: /note="Description of Artificial Sequence: Synthetic oligonucleotide"
acgcuaucaugcguucucc

SEQ ID NO: 165 - RNA, 19 nt, Artificial Sequence
  source: /note="Description of Artificial Sequence: Synthetic oligonucleotide"
caugcaccuuugcgugagc

SEQ ID NO: 166 - RNA, 19 nt, Artificial Sequence
  source: /note="Description of Artificial Sequence: Synthetic oligonucleotide"
gaaugcaguucgccuucac

SEQ ID NO: 167 - RNA, 19 nt, Artificial Sequence
  source: /note="Description of Artificial Sequence: Synthetic oligonucleotide"
ggugccauuccacgacuag

SEQ ID NO: 168 - RNA, 19 nt, Artificial Sequence
  source: /note="Description of Artificial Sequence: Synthetic oligonucleotide"
aagcggcuguuagucacug

SEQ ID NO: 169 - RNA, 19 nt, Artificial Sequence
  source: /note="Description of Artificial Sequence: Synthetic oligonucleotide"
ucgagcucagaggguacga

SEQ ID NO: 170 - RNA, 19 nt, Artificial Sequence
  source: /note="Description of Artificial Sequence: Synthetic oligonucleotide"
gacacgcuaucaugcguuc

SEQ ID NO: 171 - RNA, 19 nt, Artificial Sequence
  source: /note="Description of Artificial Sequence: Synthetic oligonucleotide"
cgcuaucaugcguucuccu

SEQ ID NO: 172 - RNA, 19 nt, Artificial Sequence
  source: /note="Description of Artificial Sequence: Synthetic oligonucleotide"
gugucugcuauuguacgua

SEQ ID NO: 173 - RNA, 19 nt, Artificial Sequence
  source: /note="Description of Artificial Sequence: Synthetic oligonucleotide"
gucugcucuaguaauaagc

SEQ ID NO: 174 - RNA, 19 nt, Artificial Sequence
  source: /note="Description of Artificial Sequence: Synthetic oligonucleotide"
gugccauuccacgacuagu

SEQ ID NO: 175 - RNA, 19 nt, Artificial Sequence
  source: /note="Description of Artificial Sequence: Synthetic oligonucleotide"
auguucacaaccgaauugu

SEQ ID NO: 176 - RNA, 19 nt, Artificial Sequence
  source: /note="Description of Artificial Sequence: Synthetic oligonucleotide"
ccacgacuaguucaguugc

SEQ ID NO: 177 - RNA, 19 nt, Artificial Sequence
  source: /note="Description of Artificial Sequence: Synthetic oligonucleotide"
cacgacuaguucaguugcu

SEQ ID NO: 178 - RNA, 19 nt, Artificial Sequence
  source: /note="Description of Artificial Sequence: Synthetic oligonucleotide"
aguucaguugcuuguucgu

SEQ ID NO: 179 - RNA, 19 nt, Artificial Sequence
  source: /note="Description of Artificial Sequence: Synthetic oligonucleotide"
cccagcgccguacguccau

SEQ ID NO: 180 - RNA, 19 nt, Artificial Sequence
  source: /note="Description of Artificial Sequence: Synthetic oligonucleotide"
gaguuacuucacucuagga

SEQ ID NO: 181 - RNA, 19 nt, Artificial Sequence
  source: /note="Description of Artificial Sequence: Synthetic oligonucleotide"
acaguaugcaaugacucga

SEQ ID NO: 182 - RNA, 19 nt, Artificial Sequence
  source: /note="Description of Artificial Sequence: Synthetic oligonucleotide"
uaugcaaugacucgagcuc

SEQ ID NO: 183 - RNA, 19 nt, Artificial Sequence
  source: /note="Description of Artificial Sequence: Synthetic oligonucleotide"
cccacuaauguccagcguu

SEQ ID NO: 184 - RNA, 19 nt, Artificial Sequence
  source: /note="Description of Artificial Sequence: Synthetic oligonucleotide"
gaccuugcauaaccuuucc

SEQ ID NO: 185 - RNA, 19 nt, Artificial Sequence
  source: /note="Description of Artificial Sequence: Synthetic oligonucleotide"
uauuacgacagacugccuu

SEQ ID NO: 186 - RNA, 19 nt, Artificial Sequence
  source: /note="Description of Artificial Sequence: Synthetic oligonucleotide"
aucugaccagccgacacca

SEQ ID NO: 187 - RNA, 19 nt, Artificial Sequence
  source: /note="Description of Artificial Sequence: Synthetic oligonucleotide"
cauuccacgacuaguucag

SEQ ID NO: 188 - RNA, 19 nt, Artificial Sequence
  source: /note="Description of Artificial Sequence: Synthetic oligonucleotide"
guuuugaaaauccagcgug

SEQ ID NO: 189 - RNA, 19 nt, Artificial Sequence
  source: /note="Description of Artificial Sequence: Synthetic oligonucleotide"
gcguuuggcugaaccauca

SEQ ID NO: 190 - RNA, 19 nt, Artificial Sequence
  source: /note="Description of Artificial Sequence: Synthetic oligonucleotide"
acacgcuaucaugcguucu

SEQ ID NO: 191 - RNA, 19 nt, Artificial Sequence
  source: /note="Description of Artificial Sequence: Synthetic oligonucleotide"
uaugccauuacaacucucc

SEQ ID NO: 192 - RNA, 19 nt, Artificial Sequence
  source: /note="Description of Artificial Sequence: Synthetic oligonucleotide"
ucugcucuaguaauaagcc

SEQ ID NO: 193 - RNA, 19 nt, Artificial Sequence
  source: /note="Description of Artificial Sequence: Synthetic oligonucleotide"
cgggauguucacaaccgaa

SEQ ID NO: 194 - RNA, 19 nt, Artificial Sequence
  source: /note="Description of Artificial Sequence: Synthetic oligonucleotide"
acaauacaaauggauuuug

SEQ ID NO: 195 - RNA, 19 nt, Artificial Sequence
  source: /note="Description of Artificial Sequence: Synthetic oligonucleotide"
acaaauggauuuugggagu

SEQ ID NO: 196 - RNA, 19 nt, Artificial Sequence
  source: /note="Description of Artificial Sequence: Synthetic oligonucleotide"
uugggagugacucaagaag

SEQ ID NO: 197 - RNA, 19 nt, Artificial Sequence
  source: /note="Description of Artificial Sequence: Synthetic oligonucleotide"
ugggagugacucaagaagu

SEQ ID NO: 198 - RNA, 19 nt, Artificial Sequence
  source: /note="Description of Artificial Sequence: Synthetic oligonucleotide"
gaagugaagaaugcacaag

SEQ ID NO: 199 - RNA, 19 nt, Artificial Sequence
  source: /note="Description of Artificial Sequence: Synthetic oligonucleotide"
aagugaagaaugcacaaga

SEQ ID NO: 200 - RNA, 19 nt, Artificial Sequence
  source: /note="Description of Artificial Sequence: Synthetic oligonucleotide"
gauggaauuuaucaaaccc

SEQ ID NO: 201 - RNA, 19 nt, Artificial Sequence
  source: /note="Description of Artificial Sequence: Synthetic oligonucleotide"
auggaauuuaucaaacccu

SEQ ID NO: 202 - RNA, 19 nt, Artificial Sequence
  source: /note="Description of Artificial Sequence: Synthetic oligonucleotide"
ggaauuuaucaaacccuag

SEQ ID NO: 203 - RNA, 19 nt, Artificial Sequence
  source: /note="Description of Artificial Sequence: Synthetic oligonucleotide"
gaauuuaucaaacccuagc

SEQ ID NO: 204 - RNA, 19 nt, Artificial Sequence
  source: /note="Description of Artificial Sequence: Synthetic oligonucleotide"
aauuuaucaaacccuagcc

SEQ ID NO: 205 - RNA, 19 nt, Artificial Sequence
  source: /note="Description of Artificial Sequence: Synthetic oligonucleotide"
gaauaucuguaaugguacu

SEQ ID NO: 206 - RNA, 19 nt, Artificial Sequence
  source: /note="Description of Artificial Sequence: Synthetic oligonucleotide"
aauaucuguaaugguacug

SEQ ID NO: 207 - RNA, 19 nt, Artificial Sequence
  source: /note="Description of Artificial Sequence: Synthetic oligonucleotide"
auaucuguaaugguacuga

SEQ ID NO: 208 - RNA, 19 nt, Artificial Sequence
  source: /note="Description of Artificial Sequence: Synthetic oligonucleotide"
uuuuaagucucucguagug

SEQ ID NO: 209 - RNA, 19 nt, Artificial Sequence
  source: /note="Description of Artificial Sequence: Synthetic oligonucleotide"
uuuaagucucucguagugu

SEQ ID NO: 210 - RNA, 19 nt, Artificial Sequence
  source: /note="Description of Artificial Sequence: Synthetic oligonucleotide"
agucucucguaguguuaag

SEQ ID NO: 211 - RNA, 19 nt, Artificial Sequence
  source: /note="Description of Artificial Sequence: Synthetic oligonucleotide"
ucguaguguuaaguuauag

SEQ ID NO: 212 - RNA, 19 nt, Artificial Sequence
  source: /note="Description of Artificial Sequence: Synthetic oligonucleotide"
cguaguguuaaguuauagu

SEQ ID NO: 213 - RNA, 19 nt, Artificial Sequence
  source: /note="Description of Artificial Sequence: Synthetic oligonucleotide"
guaguguuaaguuauagug

SEQ ID NO: 214 - RNA, 19 nt, Artificial Sequence
  source: /note="Description of Artificial Sequence: Synthetic oligonucleotide"
uaguguuaaguuauaguga

SEQ ID NO: 215 - RNA, 19 nt, Artificial Sequence
  source: /note="Description of Artificial Sequence: Synthetic oligonucleotide"
uagugaauacugcuacagc

SEQ ID NO: 216 - RNA, 19 nt, Artificial Sequence
  source: /note="Description of Artificial Sequence: Synthetic oligonucleotide"
aacacuaauucauaaucac

SEQ ID NO: 217 - RNA, 19 nt, Artificial Sequence
  source: /note="Description of Artificial Sequence: Synthetic oligonucleotide"
acacuaauucauaaucacu

SEQ ID NO: 218 - RNA, 19 nt, Artificial Sequence
  source: /note="Description of Artificial Sequence: Synthetic oligonucleotide"
uaauuguaaucugaauaaa

SEQ ID NO: 219 - RNA, 19 nt, Artificial Sequence
  source: /note="Description of Artificial Sequence: Synthetic oligonucleotide"
auuguaaucugaauaaagu

SEQ ID NO: 220 - RNA, 19 nt, Artificial Sequence
  source: /note="Description of Artificial Sequence: Synthetic oligonucleotide"
uuguaaucugaauaaagug

SEQ ID NO: 221 - RNA, 19 nt, Artificial Sequence
  source: /note="Description of Artificial Sequence: Synthetic oligonucleotide"
uguaaucugaauaaagugu

SEQ ID NO: 222 - RNA, 19 nt, Artificial Sequence
  source: /note="Description of Artificial Sequence: Synthetic oligonucleotide"
gacaaauagaaaauggucc

SEQ ID NO: 223 - RNA, 19 nt, Artificial Sequence
  source: /note="Description of Artificial Sequence: Synthetic oligonucleotide"
acaaauagaaaauggucca

SEQ ID NO: 224 - RNA, 19 nt, Artificial Sequence
  source: /note="Description of Artificial Sequence: Synthetic oligonucleotide"
uagaaaaugguccaauuag

SEQ ID NO: 225 - RNA, 19 nt, Artificial Sequence
  source: /note="Description of Artificial Sequence: Synthetic oligonucleotide"
agaaaaugguccaauuagu

SEQ ID NO: 226 - RNA, 19 nt, Artificial Sequence
  source: /note="Description of Artificial Sequence: Synthetic oligonucleotide"
uauuugggauauguauggg

SEQ ID NO: 227 - RNA, 19 nt, Artificial Sequence
  source: /note="Description of Artificial Sequence: Synthetic oligonucleotide"
auuugggauauguaugggu

SEQ ID NO: 228 - RNA, 19 nt, Artificial Sequence
  source: /note="Description of Artificial Sequence: Synthetic oligonucleotide"
uugggauauguauggguag

SEQ ID NO: 229 - RNA, 19 nt, Artificial Sequence
  source: /note="Description of Artificial Sequence: Synthetic oligonucleotide"
ggauauguauggguagggu

SEQ ID NO: 230 - RNA, 19 nt, Artificial Sequence
  source: /note="Description of Artificial Sequence: Synthetic oligonucleotide"
aagagguguuauuuggaac

SEQ ID NO: 231 - RNA, 19 nt, Artificial Sequence
  source: /note="Description of Artificial Sequence: Synthetic oligonucleotide"
agagguguuauuuggaacc

SEQ ID NO: 232 - RNA, 19 nt, Artificial Sequence
  source: /note="Description of Artificial Sequence: Synthetic oligonucleotide"
gagguguuauuuggaaccu

SEQ ID NO: 233 - RNA, 19 nt, Artificial Sequence
  source: /note="Description of Artificial Sequence: Synthetic oligonucleotide"
uggaaccuuguuuuggaca

SEQ ID NO: 234 - RNA, 19 nt, Artificial Sequence
  source: /note="Description of Artificial Sequence: Synthetic oligonucleotide"
ggaaccuuguuuuggacag

SEQ ID NO: 235 - RNA, 19 nt, Artificial Sequence
  source: /note="Description of Artificial Sequence: Synthetic oligonucleotide"
gaaccuuguuuuggacagu

SEQ ID NO: 236 - RNA, 19 nt, Artificial Sequence
  source: /note="Description of Artificial Sequence: Synthetic oligonucleotide"
guuuuggacaguuuaccag

SEQ ID NO: 237 - RNA, 19 nt, Artificial Sequence
  source: /note="Description of Artificial Sequence: Synthetic oligonucleotide"
uuuuggacaguuuaccagu

SEQ ID NO: 238 - RNA, 19 nt, Artificial Sequence
  source: /note="Description of Artificial Sequence: Synthetic oligonucleotide"
uuggacaguuuaccaguug

SEQ ID NO: 239 - RNA, 19 nt, Artificial Sequence
  source: /note="Description of Artificial Sequence: Synthetic oligonucleotide"
guuguuguaaccugcugug

SEQ ID NO: 240 - RNA, 19 nt, Artificial Sequence
  source: /note="Description of Artificial Sequence: Synthetic oligonucleotide"
uuguuguaaccugcuguga

SEQ ID NO: 241 - RNA, 19 nt, Artificial Sequence
  source: /note="Description of Artificial Sequence: Synthetic oligonucleotide"
uuguaaccugcugugauac

SEQ ID NO: 242 - RNA, 19 nt, Artificial Sequence
  source: /note="Description of Artificial Sequence: Synthetic oligonucleotide"
augcuucaagagaaaaugc

SEQ ID NO: 243 - RNA, 19 nt, Artificial Sequence
  source: /note="Description of Artificial Sequence: Synthetic oligonucleotide"
agugaagaaugcacaagaa

SEQ ID NO: 244 - RNA, 19 nt, Artificial Sequence
  source: /note="Description of Artificial Sequence: Synthetic oligonucleotide"
aauggaucacaagauggaa

SEQ ID NO: 245 - RNA, 19 nt, Artificial Sequence
  source: /note="Description of Artificial Sequence: Synthetic oligonucleotide"
auggaucacaagauggaau

SEQ ID NO: 246 - RNA, 19 nt, Artificial Sequence
  source: /note="Description of Artificial Sequence: Synthetic oligonucleotide"
uggaucacaagauggaauu

SEQ ID NO: 247 - RNA, 19 nt, Artificial Sequence
  source: /note="Description of Artificial Sequence: Synthetic oligonucleotide"
ggaucacaagauggaauuu

SEQ ID NO: 248 - RNA, 19 nt, Artificial Sequence
  source: /note="Description of Artificial Sequence: Synthetic oligonucleotide"
gaucacaagauggaauuua

SEQ ID NO: 249 - RNA, 19 nt, Artificial Sequence
  source: /note="Description of Artificial Sequence: Synthetic oligonucleotide"
aucacaagauggaauuuau

SEQ ID NO: 250 - RNA, 19 nt, Artificial Sequence
  source: /note="Description of Artificial Sequence: Synthetic oligonucleotide"
uggaauuuaucaaacccua

SEQ ID NO: 251 - RNA, 19 nt, Artificial Sequence
  source: /note="Description of Artificial Sequence: Synthetic oligonucleotide"
acccuagccuugcuuguua

SEQ ID NO: 252 - RNA, 19 nt, Artificial Sequence
  source: /note="Description of Artificial Sequence: Synthetic oligonucleotide"
cccuagccuugcuuguuaa

SEQ ID NO: 253 - RNA, 19 nt, Artificial Sequence
  source: /note="Description of Artificial Sequence: Synthetic oligonucleotide"
ccuagccuugcuuguuaaa

SEQ ID NO: 254 - RNA, 19 nt, Artificial Sequence
  source: /note="Description of Artificial Sequence: Synthetic oligonucleotide"
cuagccuugcuuguuaaau

SEQ ID NO: 255 - RNA, 19 nt, Artificial Sequence
  source: /note="Description of Artificial Sequence: Synthetic oligonucleotide"
uagccuugcuuguuaaauu

SEQ ID NO: 256 - RNA, 19 nt, Artificial Sequence
  source: /note="Description of Artificial Sequence: Synthetic oligonucleotide"
agccuugcuuguuaaauuu

SEQ ID NO: 257 - RNA, 19 nt, Artificial Sequence
  source: /note="Description of Artificial Sequence: Synthetic oligonucleotide"
uuaagucucucguaguguu

SEQ ID NO: 258 - RNA, 19 nt, Artificial Sequence
  source: /note="Description of Artificial Sequence: Synthetic oligonucleotide"
uaagucucucguaguguua

SEQ ID NO: 259 - RNA, 19 nt, Artificial Sequence
  source: /note="Description of Artificial Sequence: Synthetic oligonucleotide"
aagucucucguaguguuaa

SEQ ID NO: 260 - RNA, 19 nt, Artificial Sequence
  source: /note="Description of Artificial Sequence: Synthetic oligonucleotide"
cucguaguguuaaguuaua

SEQ ID NO: 261 - RNA, 19 nt, Artificial Sequence
  source: /note="Description of Artificial Sequence: Synthetic oligonucleotide"
aguguuaaguuauagugaa

SEQ ID NO: 262 - RNA, 19 nt, Artificial Sequence
  source: /note="Description of Artificial Sequence: Synthetic oligonucleotide"
guguuaaguuauagugaau

SEQ ID NO: 263 - RNA, 19 nt, Artificial Sequence
  source: /note="Description of Artificial Sequence: Synthetic oligonucleotide"
cuacagcaauuucuaauuu

SEQ ID NO: 264 - RNA, 19 nt, Artificial Sequence
  source: /note="Description of Artificial Sequence: Synthetic oligonucleotide"
caaauagaaaaugguccaa

SEQ ID NO: 265 - RNA, 19 nt, Artificial Sequence
  source: /note="Description of Artificial Sequence: Synthetic oligonucleotide"
auagaaaaugguccaauua

SEQ ID NO: 266 - RNA, 19 nt, Artificial Sequence
  source: /note="Description of Artificial Sequence: Synthetic oligonucleotide"
uuugggauauguaugggua

SEQ ID NO: 267 - RNA, 19 nt, Artificial Sequence
  source: /note="Description of Artificial Sequence: Synthetic oligonucleotide"
gauauguauggguagggua

SEQ ID NO: 268 - RNA, 19 nt, Artificial Sequence
  source: /note="Description of Artificial Sequence: Synthetic oligonucleotide"
uggguaggguaaaucagua

SEQ ID NO: 269 - RNA, 19 nt, Artificial Sequence
  source: /note="Description of Artificial Sequence: Synthetic oligonucleotide"
uaagagguguuauuuggaa

SEQ ID NO: 270 - RNA, 19 nt, Artificial Sequence
  source: /note="Description of Artificial Sequence: Synthetic oligonucleotide"
ugccuuuuaucccaaaguu

SEQ ID NO: 271 - RNA, 19 nt, Artificial Sequence
  source: /note="Description of Artificial Sequence: Synthetic oligonucleotide"
uguuguaaccugcugugau

SEQ ID NO: 272 - RNA, 19 nt, Artificial Sequence
  source: /note="Description of Artificial Sequence: Synthetic oligonucleotide"
guuguaaccugcugugaua

SEQ ID NO: 273 - RNA, 19 nt, Artificial Sequence
  source: /note="Description of Artificial Sequence: Synthetic oligonucleotide"
caagagaaaaugcgguuau

SEQ ID NO: 274 - RNA, 19 nt, Artificial Sequence
  source: /note="Description of Artificial Sequence: Synthetic oligonucleotide"
aagagaaaaugcgguuaua

SEQ ID NO: 275 - RNA, 19 nt, Artificial Sequence
  source: /note="Description of Artificial Sequence: Synthetic oligonucleotide"
ccuguuccccugaggguau

SEQ ID NO: 276 - RNA, 19 nt, Artificial Sequence
  source: /note="Description of Artificial Sequence: Synthetic oligonucleotide"
cuguuccccugaggguauu

SEQ ID NO: 277 - RNA, 19 nt, Artificial Sequence
  source: /note="Description of Artificial Sequence: Synthetic oligonucleotide"
ccugaggguauuugaagua

SEQ ID NO: 278 - RNA, 19 nt, Artificial Sequence
  source: /note="Description of Artificial Sequence: Synthetic oligonucleotide"
cugaggguauuugaaguau

SEQ ID NO: 279 - RNA, 19 nt, Artificial Sequence
  source: /note="Description of Artificial Sequence: Synthetic oligonucleotide"
ugaggguauuugaaguaua

SEQ ID NO: 280 - RNA, 19 nt, Artificial Sequence
  source: /note="Description of Artificial Sequence: Synthetic oligonucleotide"
gguauuugaaguauaccau

SEQ ID NO: 281 - RNA, 19 nt, Artificial Sequence
  source: /note="Description of Artificial Sequence: Synthetic oligonucleotide"
guauuugaaguauaccaua

SEQ ID NO: 282 - RNA, 19 nt, Artificial Sequence
  source: /note="Description of Artificial Sequence: Synthetic oligonucleotide"
uuugaaguauaccauacaa

SEQ ID NO: 283 - RNA, 19 nt, Artificial Sequence
  source: /note="Description of Artificial Sequence: Synthetic oligonucleotide"
aguauaccauacaacuguu

SEQ ID NO: 284 - RNA, 19 nt, Artificial Sequence
  source: /note="Description of Artificial Sequence: Synthetic oligonucleotide"
guauaccauacaacuguuu

SEQ ID NO: 285 - RNA, 19 nt, Artificial Sequence
  source: /note="Description of Artificial Sequence: Synthetic oligonucleotide"
uauaccauacaacuguuuu

SEQ ID NO: 286 - RNA, 19 nt, Artificial Sequence
  source: /note="Description of Artificial Sequence: Synthetic oligonucleotide"
accauacaacuguuuugaa

SEQ ID NO: 287 - RNA, 19 nt, Artificial Sequence
  source: /note="Description of Artificial Sequence: Synthetic oligonucleotide"
ccauacaacuguuuugaaa

SEQ ID NO: 288 - RNA, 19 nt, Artificial Sequence
  source: /note="Description of Artificial Sequence: Synthetic oligonucleotide"
gaaaauccagcguggacaa

SEQ ID NO: 289 - RNA, 19 nt, Artificial Sequence
  source: /note="Description of Artificial Sequence: Synthetic oligonucleotide"
aaaauccagcguggacaau

SEQ ID NO: 290 - RNA, 19 nt, Artificial Sequence
  source: /note="Description of Artificial Sequence: Synthetic oligonucleotide"
ccagcguggacaauggcua

SEQ ID NO: 291 - RNA, 19 nt, Artificial Sequence
  source: /note="Description of Artificial Sequence: Synthetic oligonucleotide"
guggacaauggcuacucaa

SEQ ID NO: 292 - RNA, 19 nt, Artificial Sequence
  source: /note="Description of Artificial Sequence: Synthetic oligonucleotide"
aauggcuacucaagcugau

SEQ ID NO: 293 - RNA, 19 nt, Artificial Sequence
  source: /note="Description of Artificial Sequence: Synthetic oligonucleotide"
auggcuacucaagcugauu

SEQ ID NO: 294 - RNA, 19 nt, Artificial Sequence
  source: /note="Description of Artificial Sequence: Synthetic oligonucleotide"
uggcuacucaagcugauuu

SEQ ID NO: 295 - RNA, 19 nt, Artificial Sequence
  source: /note="Description of Artificial Sequence: Synthetic oligonucleotide"
cuacucaagcugauuugau

SEQ ID NO: 296 - RNA, 19 nt, Artificial Sequence
  source: /note="Description of Artificial Sequence: Synthetic oligonucleotide"
auuugauggaguuggacau

SEQ ID NO: 297 - RNA, 19 nt, Artificial Sequence
  source: /note="Description of Artificial Sequence: Synthetic oligonucleotide"
uggaguuggacauggccau

SEQ ID NO: 298 - RNA, 19 nt, Artificial Sequence
  source: /note="Description of Artificial Sequence: Synthetic oligonucleotide"
guuggacauggccauggaa

SEQ ID NO: 299 - RNA, 19 nt, Artificial Sequence
  source: /note="Description of Artificial Sequence: Synthetic oligonucleotide"
gccauggaaccagacagaa

SEQ ID NO: 300 - RNA, 19 nt, Artificial Sequence
  source: /note="Description of Artificial Sequence: Synthetic oligonucleotide"
cauggaaccagacagaaaa

SEQ ID NO: 301 - RNA, 19 nt, Artificial Sequence
  source: /note="Description of Artificial Sequence: Synthetic oligonucleotide"
ggaggcggagacggaggaa

SEQ ID NO: 302 - RNA, 19 nt, Artificial Sequence
  source: /note="Description of Artificial Sequence: Synthetic oligonucleotide"
agacagaaaagcggcuguu

SEQ ID NO: 303 - RNA, 19 nt, Artificial Sequence
  source: /note="Description of Artificial Sequence: Synthetic oligonucleotide"
gacagaaaagcggcuguua

SEQ ID NO: 304 - RNA, 19 nt, Artificial Sequence
  source: /note="Description of Artificial Sequence: Synthetic oligonucleotide"
uguuagucacuggcagcaa

SEQ ID NO: 305 - RNA, 19 nt, Artificial Sequence
  source: /note="Description of Artificial Sequence: Synthetic oligonucleotide"
cacuggcagcaacagucuu

SEQ ID NO: 306 - RNA, 19 nt, Artificial Sequence
  source: /note="Description of Artificial Sequence: Synthetic oligonucleotide"
acuggcagcaacagucuua

SEQ ID NO: 307 - RNA, 19 nt, Artificial Sequence
  source: /note="Description of Artificial Sequence: Synthetic oligonucleotide"
ucuuaccuggacucuggaa

SEQ ID NO: 308 - RNA, 19 nt, Artificial Sequence
  source: /note="Description of Artificial Sequence: Synthetic oligonucleotide"
cuuaccuggacucuggaau

SEQ ID NO: 309 - RNA, 19 nt, Artificial Sequence
  source: /note="Description of Artificial Sequence: Synthetic oligonucleotide"
ccuggacucuggaauccau

SEQ ID NO: 310 - RNA, 19 nt, Artificial Sequence
  source: /note="Description of Artificial Sequence: Synthetic oligonucleotide"
ggcuagugguggaccccaa

SEQ ID NO: 311 - RNA, 19 nt, Artificial Sequence
  source: /note="Description of Artificial Sequence: Synthetic oligonucleotide"
gccacuaccacagcuccuu

SEQ ID NO: 312 - RNA, 19 nt, Artificial Sequence
  source: /note="Description of Artificial Sequence: Synthetic oligonucleotide"
uccuucucugagugguaaa

SEQ ID NO: 313 - RNA, 19 nt, Artificial Sequence
  source: /note="Description of Artificial Sequence: Synthetic oligonucleotide"
cucugagugguaaaggcaa

SEQ ID NO: 314 - RNA, 19 nt, Artificial Sequence
  source: /note="Description of Artificial Sequence: Synthetic oligonucleotide"
uaaaggcaauccugaggaa

SEQ ID NO: 315 - RNA, 19 nt, Artificial Sequence
  source: /note="Description of Artificial Sequence: Synthetic oligonucleotide"
caauccugaggaagaggau

SEQ ID NO: 316 - RNA, 19 nt, Artificial Sequence
  source: /note="Description of Artificial Sequence: Synthetic oligonucleotide"
ugaggaagaggauguggau

SEQ ID NO: 317 - RNA, 19 nt, Artificial Sequence
  source: /note="Description of Artificial Sequence: Synthetic oligonucleotide"
auaccucccaaguccugua

SEQ ID NO: 318 - RNA, 19 nt, Artificial Sequence
  source: /note="Description of Artificial Sequence: Synthetic oligonucleotide"
uaccucccaaguccuguau

SEQ ID NO: 319 - RNA, 19 nt, Artificial Sequence
  source: /note="Description of Artificial Sequence: Synthetic oligonucleotide"
aguccuguaugagugggaa

SEQ ID NO: 320 - RNA, 19 nt, Artificial Sequence
  source: /note="Description of Artificial Sequence: Synthetic oligonucleotide"
uaugagugggaacagggau

SEQ ID NO: 321 - RNA, 19 nt, Artificial Sequence
  source: /note="Description of Artificial Sequence: Synthetic oligonucleotide"
caagcuuuaguaaauauaa

SEQ ID NO: 322 - RNA, 19 nt, Artificial Sequence
  source: /note="Description of Artificial Sequence: Synthetic oligonucleotide"
aagcuuuaguaaauauaau

SEQ ID NO: 323 - RNA, 19 nt, Artificial Sequence
  source: /note="Description of Artificial Sequence: Synthetic oligonucleotide"
ugagugggaacagggauuu

SEQ ID NO: 324 - RNA, 19 nt, Artificial Sequence
  source: /note="Description of Artificial Sequence: Synthetic oligonucleotide"
gagugggaacagggauuuu

SEQ ID NO: 325 - RNA, 19 nt, Artificial Sequence
  source: /note="Description of Artificial Sequence: Synthetic oligonucleotide"
agggauuuucucaguccuu

SEQ ID NO: 326 - RNA, 19 nt, Artificial Sequence
  source: /note="Description of Artificial Sequence: Synthetic oligonucleotide"
uucucaguccuucacucaa

SEQ ID NO: 327 - RNA, 19 nt, Artificial Sequence
  source: /note="Description of Artificial Sequence: Synthetic oligonucleotide"
ucaguccuucacucaagaa

SEQ ID NO: 328 - RNA, 19 nt, Artificial Sequence
  source: /note="Description of Artificial Sequence: Synthetic oligonucleotide"
cuucacucaagaacaagua

SEQ ID NO: 329 - RNA, 19 nt, Artificial Sequence
  source: /note="Description of Artificial Sequence: Synthetic oligonucleotide"
ucaagaacaaguagcugau

SEQ ID NO: 330 - RNA, 19 nt, Artificial Sequence
  source: /note="Description of Artificial Sequence: Synthetic oligonucleotide"
cugauauugauggacagua

SEQ ID NO: 331 - RNA, 19 nt, Artificial Sequence
  source: /note="Description of Artificial Sequence: Synthetic oligonucleotide"
auugauggacaguaugcaa

SEQ ID NO: 332 - RNA, 19 nt, Artificial Sequence
  source: /note="Description of Artificial Sequence: Synthetic oligonucleotide"
gacucgagcucagagggua

SEQ ID NO: 333 - RNA, 19 nt, Artificial Sequence
  source: /note="Description of Artificial Sequence: Synthetic oligonucleotide"
cagaggguacgagcugcua

SEQ ID NO: 334 - RNA, 19 nt, Artificial Sequence
  source: /note="Description of Artificial Sequence: Synthetic oligonucleotide"
agaggguacgagcugcuau

SEQ ID NO: 335 - RNA, 19 nt, Artificial Sequence
  source: /note="Description of Artificial Sequence: Synthetic oligonucleotide"
ggguacgagcugcuauguu

SEQ ID NO: 336 - RNA, 19 nt, Artificial Sequence
  source: /note="Description of Artificial Sequence: Synthetic oligonucleotide"
cuauguucccugagacauu

SEQ ID NO: 337 - RNA, 19 nt, Artificial Sequence
  source: /note="Description of Artificial Sequence: Synthetic oligonucleotide"
uauguucccugagacauua

SEQ ID NO: 338 - RNA, 19 nt, Artificial Sequence
  source: /note="Description of Artificial Sequence: Synthetic oligonucleotide"
guucccugagacauuagau

SEQ ID NO: 339 - RNA, 19 nt, Artificial Sequence
  source: /note="Description of Artificial Sequence: Synthetic oligonucleotide"
uagaugagggcaugcagau

SEQ ID NO: 340 - RNA, 19 nt, Artificial Sequence
  source: /note="Description of Artificial Sequence: Synthetic oligonucleotide"
gagggcaugcagaucccau

SEQ ID NO: 341 - RNA, 19 nt, Artificial Sequence
  source: /note="Description of Artificial Sequence: Synthetic oligonucleotide"
ggcaugcagaucccaucua

SEQ ID NO: 342 - RNA, 19 nt, Artificial Sequence
  source: /note="Description of Artificial Sequence: Synthetic oligonucleotide"
agaucccaucuacacaguu

SEQ ID NO: 343 - RNA, 19 nt, Artificial Sequence
  source: /note="Description of Artificial Sequence: Synthetic oligonucleotide"
cccaucuacacaguuugau

SEQ ID NO: 344 - RNA, 19 nt, Artificial Sequence
  source: /note="Description of Artificial Sequence: Synthetic oligonucleotide"
acaguuugaugcugcucau

SEQ ID NO: 345 - RNA, 19 nt, Artificial Sequence
  source: /note="Description of Artificial Sequence: Synthetic oligonucleotide"
gaugcugcucaucccacua

SEQ ID NO: 346 - RNA, 19 nt, Artificial Sequence
  source: /note="Description of Artificial Sequence: Synthetic oligonucleotide"
augcugcucaucccacuaa

SEQ ID NO: 347 - RNA, 19 nt, Artificial Sequence
  source: /note="Description of Artificial Sequence: Synthetic oligonucleotide"
ugcugcucaucccacuaau

SEQ ID NO: 348 - RNA, 19 nt, Artificial Sequence
  source: /note="Description of Artificial Sequence: Synthetic oligonucleotide"
cccacuaauguccagcguu

SEQ ID NO: 349 - RNA, 19 nt, Artificial Sequence
  source: /note="Description of Artificial Sequence: Synthetic oligonucleotide"
cagcguuuggcugaaccau

SEQ ID NO: 350 - RNA, 19 nt, Artificial Sequence
  source: /note="Description of Artificial Sequence: Synthetic oligonucleotide"
uggcugaaccaucacagau

SEQ ID NO: 351 - RNA, 19 nt, Artificial Sequence
  source: /note="Description of Artificial Sequence: Synthetic oligonucleotide"
aaccaucacagaugcugaa

SEQ ID NO: 352 - RNA, 19 nt, Artificial Sequence
  source: /note="Description of Artificial Sequence: Synthetic oligonucleotide"
accaucacagaugcugaaa

SEQ ID NO: 353 - RNA, 19 nt, Artificial Sequence
  source: /note="Description of Artificial Sequence: Synthetic oligonucleotide"
aucacagaugcugaaacau

SEQ ID NO: 354 - RNA, 19 nt, Artificial Sequence
  source: /note="Description of Artificial Sequence: Synthetic oligonucleotide"
gaugcugaaacaugcaguu

SEQ ID NO: 355 - RNA, 19 nt, Artificial Sequence
  source: /note="Description of Artificial Sequence: Synthetic oligonucleotide"
cugaaacaugcaguuguaa

SEQ ID NO: 356 - RNA, 19 nt, Artificial Sequence
  source: /note="Description of Artificial Sequence: Synthetic oligonucleotide"
aacaugcaguuguaaacuu

SEQ ID NO: 357 - RNA, 19 nt, Artificial Sequence
  source: /note="Description of Artificial Sequence: Synthetic oligonucleotide"
augcaguuguaaacuugau

SEQ ID NO: 358 - RNA, 19 nt, Artificial Sequence
  source: /note="Description of Artificial Sequence: Synthetic oligonucleotide"
ugcaguuguaaacuugauu

SEQ ID NO: 359 - RNA, 19 nt, Artificial Sequence
  source: /note="Description of Artificial Sequence: Synthetic oligonucleotide"
caguuguaaacuugauuaa

SEQ ID NO: 360 - RNA, 19 nt, Artificial Sequence
  source: /note="Description of Artificial Sequence: Synthetic oligonucleotide"
cuugauuaacuaucaagau

SEQ ID NO: 361 - RNA, 19 nt, Artificial Sequence
  source: /note="Description of Artificial Sequence: Synthetic oligonucleotide"
gauuaacuaucaagaugau

SEQ ID NO: 362 - RNA, 19 nt, Artificial Sequence
  source: /note="Description of Artificial Sequence: Synthetic oligonucleotide"
cuaucaagaugaugcagaa

SEQ ID NO: 363 - RNA, 19 nt, Artificial Sequence
  source: /note="Description of Artificial Sequence: Synthetic oligonucleotide"
gaacuugccacacgugcaa

SEQ ID NO: 364 - RNA, 19 nt, Artificial Sequence
  source: /note="Description of Artificial Sequence: Synthetic oligonucleotide"
aacuugccacacgugcaau

SEQ ID NO: 365 - RNA, 19 nt, Artificial Sequence
  source: /note="Description of Artificial Sequence: Synthetic oligonucleotide"
cacacgugcaaucccugaa

SEQ ID NO: 366 - RNA, 19 nt, Artificial Sequence
  source: /note="Description of Artificial Sequence: Synthetic oligonucleotide"
gcaaucccugaacugacaa

SEQ ID NO: 367 - RNA, 19 nt, Artificial Sequence
  source: /note="Description of Artificial Sequence: Synthetic oligonucleotide"
caaucccugaacugacaaa

SEQ ID NO: 368 - RNA, 19 nt, Artificial Sequence
  source: /note="Description of Artificial Sequence: Synthetic oligonucleotide"
aaucccugaacugacaaaa

SEQ ID NO: 369 - RNA, 19 nt, Artificial Sequence
  source: /note="Description of Artificial Sequence: Synthetic oligonucleotide"
ugaacugacaaaacugcua

SEQ ID NO: 370 - RNA, 19 nt, Artificial Sequence
  source: /note="Description of Artificial Sequence: Synthetic oligonucleotide"
gaacugacaaaacugcuaa

SEQ ID NO: 371 - RNA, 19 nt, Artificial Sequence
  source: /note="Description of Artificial Sequence: Synthetic oligonucleotide"
aacugacaaaacugcuaaa

SEQ ID NO: 372 - RNA, 19 nt, Artificial Sequence
  source: /note="Description of Artificial Sequence: Synthetic oligonucleotide"
acugacaaaacugcuaaau

SEQ ID NO: 373 - RNA, 19 nt, Artificial Sequence
  source: /note="Description of Artificial Sequence: Synthetic oligonucleotide"
gaggaccagguggugguua

SEQ ID NO: 374 - RNA, 19 nt, Artificial Sequence
  source: /note="Description of Artificial Sequence: Synthetic oligonucleotide"
aggaccagguggugguuaa

SEQ ID NO: 375 - RNA, 19 nt, Artificial Sequence
  source: /note="Description of Artificial Sequence: Synthetic oligonucleotide"
ggaccagguggugguuaau

SEQ ID NO: 376 - RNA, 19 nt, Artificial Sequence
  source: /note="Description of Artificial Sequence: Synthetic oligonucleotide"
gaccagguggugguuaaua

SEQ ID NO: 377 - RNA, 19 nt, Artificial Sequence
  source: /note="Description of Artificial Sequence: Synthetic oligonucleotide"
ucacuugcaauaauuauaa

SEQ ID NO: 378 - RNA, 19 nt, Artificial Sequence
  source: /note="Description of Artificial Sequence: Synthetic oligonucleotide"
cuugcaauaauuauaagaa

SEQ ID NO: 379 - RNA, 19 nt, Artificial Sequence
  source: /note="Description of Artificial Sequence: Synthetic oligonucleotide"
accagguggugguuaauaa

SEQ ID NO: 380 - RNA, 19 nt, Artificial Sequence
  source: /note="Description of Artificial Sequence: Synthetic oligonucleotide"
ggcugcaguuaugguccau

SEQ ID NO: 381 - RNA, 19 nt, Artificial Sequence
  source: /note="Description of Artificial Sequence: Synthetic oligonucleotide"
guuaugguccaucagcuuu

SEQ ID NO: 382 - RNA, 19 nt, Artificial Sequence
  source: /note="Description of Artificial Sequence: Synthetic oligonucleotide"
augguccaucagcuuucua

SEQ ID NO: 383 - RNA, 19 nt, Artificial Sequence
  source: /note="Description of Artificial Sequence: Synthetic oligonucleotide"
ugguccaucagcuuucuaa

SEQ ID NO: 384 - RNA, 19 nt, Artificial Sequence
  source: /note="Description of Artificial Sequence: Synthetic oligonucleotide"
ucgggcuggugacagggaa

SEQ ID NO: 385 - RNA, 19 nt, Artificial Sequence
  source: /note="Description of Artificial Sequence: Synthetic oligonucleotide"
gguccaucagcuuucuaaa

SEQ ID NO: 386 - RNA, 19 nt, Artificial Sequence
  source: /note="Description of Artificial Sequence: Synthetic oligonucleotide"
guccaucagcuuucuaaaa

SEQ ID NO: 387 - RNA, 19 nt, Artificial Sequence
  source: /note="Description of Artificial Sequence: Synthetic oligonucleotide"
gaagcuuccagacacgcua

SEQ ID NO: 388 - RNA, 19 nt, Artificial Sequence
  source: /note="Description of Artificial Sequence: Synthetic oligonucleotide"
aagcuuccagacacgcuau

SEQ ID NO: 389 - RNA, 19 nt, Artificial Sequence
  source: /note="Description of Artificial Sequence: Synthetic oligonucleotide"
cuuccagacacgcuaucau

SEQ ID NO: 390 - RNA, 19 nt, Artificial Sequence
  source: /note="Description of Artificial Sequence: Synthetic oligonucleotide"
agacacgcuaucaugcguu

SEQ ID NO: 391 - RNA, 19 nt, Artificial Sequence
  source: /note="Description of Artificial Sequence: Synthetic oligonucleotide"
ucaugcguucuccucagau

SEQ ID NO: 392 - RNA, 19 nt, Artificial Sequence
  source: /note="Description of Artificial Sequence: Synthetic oligonucleotide"
ccucagauggugucugcua

SEQ ID NO: 393 - RNA, 19 nt, Artificial Sequence
  source: /note="Description of Artificial Sequence: Synthetic oligonucleotide"
cucagauggugucugcuau

SEQ ID NO: 394 - RNA, 19 nt, Artificial Sequence
  source: /note="Description of Artificial Sequence: Synthetic oligonucleotide"
gugucugcuauuguacgua

SEQ ID NO: 395 - RNA, 19 nt, Artificial Sequence
  source: /note="Description of Artificial Sequence: Synthetic oligonucleotide"
cugcuauuguacguaccau

SEQ ID NO: 396 - RNA, 19 nt, Artificial Sequence
  source: /note="Description of Artificial Sequence: Synthetic oligonucleotide"
uuguacguaccaugcagaa

SEQ ID NO: 397 - RNA, 19 nt, Artificial Sequence
  source: /note="Description of Artificial Sequence: Synthetic oligonucleotide"
uguacguaccaugcagaau

SEQ ID NO: 398 - RNA, 19 nt, Artificial Sequence
  source: /note="Description of Artificial Sequence: Synthetic oligonucleotide"
cguaccaugcagaauacaa

SEQ ID NO: 399 - RNA, 19 nt, Artificial Sequence
  source: /note="Description of Artificial Sequence: Synthetic oligonucleotide"
caugcagaauacaaaugau

SEQ ID NO: 400 - RNA, 19 nt, Artificial Sequence
  source: /note="Description of Artificial Sequence: Synthetic oligonucleotide"
gcagaauacaaaugaugua

SEQ ID NO: 401 - RNA, 19 nt, Artificial Sequence
  source: /note="Description of Artificial Sequence: Synthetic oligonucleotide"
gaauacaaaugauguagaa

SEQ ID NO: 402 - RNA, 19 nt, Artificial Sequence
  source: /note="Description of Artificial Sequence: Synthetic oligonucleotide"
gauguagaaacagcucguu

SEQ ID NO: 403 - RNA, 19 nt, Artificial Sequence
  source: /note="Description of Artificial Sequence: Synthetic oligonucleotide"
guuguaccgcugggaccuu

SEQ ID NO: 404 - RNA, 19 nt, Artificial Sequence
  source: /note="Description of Artificial Sequence: Synthetic oligonucleotide"
uaccgcugggaccuugcau

SEQ ID NO: 405 - RNA, 19 nt, Artificial Sequence
  source: /note="Description of Artificial Sequence: Synthetic oligonucleotide"
ccgcugggaccuugcauaa

SEQ ID NO: 406 - RNA, 19 nt, Artificial Sequence
  source: /note="Description of Artificial Sequence: Synthetic oligonucleotide"
ugggaccuugcauaaccuu

SEQ ID NO: 407 - RNA, 19 nt, Artificial Sequence
  source: /note="Description of Artificial Sequence: Synthetic oligonucleotide"
gggaccuugcauaaccuuu

SEQ ID NO: 408 - RNA, 19 nt, Artificial Sequence
  source: /note="Description of Artificial Sequence: Synthetic oligonucleotide"
cuugcauaaccuuucccau

SEQ ID NO: 409 - RNA, 19 nt, Artificial Sequence
  source: /note="Description of Artificial Sequence: Synthetic oligonucleotide"
ucuuuaagucuggaggcau

SEQ ID NO: 410 - RNA, 19 nt, Artificial Sequence
  source: /note="Description of Artificial Sequence: Synthetic oligonucleotide"
gcauuccugcccuggugaa

SEQ ID NO: 411 - RNA, 19 nt, Artificial Sequence
  source: /note="Description of Artificial Sequence: Synthetic oligonucleotide"
cauuccugcccuggugaaa

SEQ ID NO: 412 - RNA, 19 nt, Artificial Sequence
  source: /note="Description of Artificial Sequence: Synthetic oligonucleotide"
auuccugcccuggugaaaa

SEQ ID NO: 413 - RNA, 19 nt, Artificial Sequence
  source: /note="Description of Artificial Sequence: Synthetic oligonucleotide"
uuccugcccuggugaaaau

SEQ ID NO: 414 - RNA, 19 nt, Artificial Sequence
  source: /note="Description of Artificial Sequence: Synthetic oligonucleotide"
ugcccuggugaaaaugcuu

SEQ ID NO: 415 - RNA, 19 nt, Artificial Sequence
  source: /note="Description of Artificial Sequence: Synthetic oligonucleotide"
cuggugaaaaugcuugguu

SEQ ID NO: 416 - RNA, 19 nt, Artificial Sequence
  source: /note="Description of Artificial Sequence: Synthetic oligonucleotide"
gcuugguucaccaguggau

SEQ ID NO: 417 - RNA, 19 nt, Artificial Sequence
  source: /note="Description of Artificial Sequence: Synthetic oligonucleotide"
cuugguucaccaguggauu

SEQ ID NO: 418 - RNA, 19 nt, Artificial Sequence
  source: /note="Description of Artificial Sequence: Synthetic oligonucleotide"
ugcgugagcagggugccau

SEQ ID NO: 419 - RNA, 19 nt, Artificial Sequence
  source: /note="Description of Artificial Sequence: Synthetic oligonucleotide"
gcgugagcagggugccauu

SEQ ID NO: 420 - RNA, 19 nt, Artificial Sequence
  source: /note="Description of Artificial Sequence: Synthetic oligonucleotide"
caccaguggauucuguguu

SEQ ID NO: 421 - RNA, 19 nt, Artificial Sequence
  source: /note="Description of Artificial Sequence: Synthetic oligonucleotide"
caguggauucuguguuguu

SEQ ID NO: 422 - RNA, 19 nt, Artificial Sequence
  source: /note="Description of Artificial Sequence: Synthetic oligonucleotide"
aguggauucuguguuguuu

SEQ ID NO: 423 - RNA, 19 nt, Artificial Sequence
  source: /note="Description of Artificial Sequence: Synthetic oligonucleotide"
guggauucuguguuguuuu

SEQ ID NO: 424 - RNA, 19 nt, Artificial Sequence
  source: /note="Description of Artificial Sequence: Synthetic oligonucleotide"
uggauucuguguuguuuua

SEQ ID NO: 425 - RNA, 19 nt, Artificial Sequence
  source: /note="Description of Artificial Sequence: Synthetic oligonucleotide"
ggauucuguguuguuuuau

SEQ ID NO: 426 - RNA, 19 nt, Artificial Sequence
  source: /note="Description of Artificial Sequence: Synthetic oligonucleotide"
uguguuguuuuaugccauu

SEQ ID NO: 427 - RNA, 19 nt, Artificial Sequence
  source: /note="Description of Artificial Sequence: Synthetic oligonucleotide"
gggugggacacagcagcaa

SEQ ID NO: 428 - RNA, 19 nt, Artificial Sequence
  source: /note="Description of Artificial Sequence: Synthetic oligonucleotide"
guguuguuuuaugccauua

SEQ ID NO: 429 - RNA, 19 nt, Artificial Sequence
  source: /note="Description of Artificial Sequence: Synthetic oligonucleotide"
uggugcugacuauccaguu

SEQ ID NO: 430 - RNA, 19 nt, Artificial Sequence
  source: /note="Description of Artificial Sequence: Synthetic oligonucleotide"
aacuggauagucagcacca

SEQ ID NO: 431 - RNA, 19 nt, Artificial Sequence
  source: /note="Description of Artificial Sequence: Synthetic oligonucleotide"
uacaacucuccacaaccuu

SEQ ID NO: 432 - RNA, 19 nt, Artificial Sequence
  source: /note="Description of Artificial Sequence: Synthetic oligonucleotide"
acaacucuccacaaccuuu

SEQ ID NO: 433 - RNA, 19 nt, Artificial Sequence
  source: /note="Description of Artificial Sequence: Synthetic oligonucleotide"
caacucuccacaaccuuuu

SEQ ID NO: 434 - RNA, 19 nt, Artificial Sequence
  source: /note="Description of Artificial Sequence: Synthetic oligonucleotide"
aacucuccacaaccuuuua

SEQ ID NO: 435 - RNA, 19 nt, Artificial Sequence
  source: /note="Description of Artificial Sequence: Synthetic oligonucleotide"
acucuccacaaccuuuuau

SEQ ID NO: 436 - RNA, 19 nt, Artificial Sequence
  source: /note="Description of Artificial Sequence: Synthetic oligonucleotide"
cucuccacaaccuuuuauu

SEQ ID NO: 437 - RNA, 19 nt, Artificial Sequence
  source: /note="Description of Artificial Sequence: Synthetic oligonucleotide"
ucuccacaaccuuuuauua

SEQ ID NO: 438 - RNA, 19 nt, Artificial Sequence
  source: /note="Description of Artificial Sequence: Synthetic oligonucleotide"
caaccuuuuauuacaucaa

SEQ ID NO: 439 - RNA, 19 nt, Artificial Sequence
  source: /note="Description of Artificial Sequence: Synthetic oligonucleotide"
ccuuuuauuacaucaagaa

SEQ ID NO: 440 - RNA, 19 nt, Artificial Sequence
  source: /note="Description of Artificial Sequence: Synthetic oligonucleotide"
uuacaucaagaaggagcua

SEQ ID NO: 441 - RNA, 19 nt, Artificial Sequence
  source: /note="Description of Artificial Sequence: Synthetic oligonucleotide"
uacaucaagaaggagcuaa

SEQ ID NO: 442 - RNA, 19 nt, Artificial Sequence
  source: /note="Description of Artificial Sequence: Synthetic oligonucleotide"
caucaagaaggagcuaaaa

SEQ ID NO: 443 - RNA, 19 nt, Artificial Sequence
  source: /note="Description of Artificial Sequence: Synthetic oligonucleotide"
aucaagaaggagcuaaaau

SEQ ID NO: 444 - RNA, 19 nt, Artificial Sequence
  source: /note="Description of Artificial Sequence: Synthetic oligonucleotide"
gcuaaaauggcagugcguu

SEQ ID NO: 445 - RNA, 19 nt, Artificial Sequence
  source: /note="Description of Artificial Sequence: Synthetic oligonucleotide"
uaaaauggcagugcguuua

SEQ ID NO: 446 - RNA, 19 nt, Artificial Sequence
  source: /note="Description of Artificial Sequence: Synthetic oligonucleotide"
aaaugguugccuugcucaa

SEQ ID NO: 447 - RNA, 19 nt, Artificial Sequence
  source: /note="Description of Artificial Sequence: Synthetic oligonucleotide"
gccuguuccccugagggua

SEQ ID NO: 448 - RNA, 19 nt, Artificial Sequence
  source: /note="Description of Artificial Sequence: Synthetic oligonucleotide"
ugguugccuugcucaacaa

SEQ ID NO: 449 - RNA, 19 nt, Artificial Sequence
  source: /note="Description of Artificial Sequence: Synthetic oligonucleotide"
gguugccuugcucaacaaa

SEQ ID NO: 450 - RNA, 19 nt, Artificial Sequence
  source: /note="Description of Artificial Sequence: Synthetic oligonucleotide"
guugccuugcucaacaaaa

SEQ ID NO: 451 - RNA, 19 nt, Artificial Sequence
  source: /note="Description of Artificial Sequence: Synthetic oligonucleotide"
gccuugcucaacaaaacaa

SEQ ID NO: 452 - RNA, 19 nt, Artificial Sequence
  source: /note="Description of Artificial Sequence: Synthetic oligonucleotide"
ccuugcucaacaaaacaaa

SEQ ID NO: 453 - RNA, 19 nt, Artificial Sequence
  source: /note="Description of Artificial Sequence: Synthetic oligonucleotide"
guuaaauucuuggcuauua

SEQ ID NO: 454 - RNA, 19 nt, Artificial Sequence
  source: /note="Description of Artificial Sequence: Synthetic oligonucleotide"
uauuacgacagacugccuu

SEQ ID NO: 455 - RNA, 19 nt, Artificial Sequence
  source: /note="Description of Artificial Sequence: Synthetic oligonucleotide"
auggcaaccaagaaagcaa

SEQ ID NO: 456 - RNA, 19 nt, Artificial Sequence
  source: /note="Description of Artificial Sequence: Synthetic oligonucleotide"
agugguggaccccaagcuu

SEQ ID NO: 457 - RNA, 19 nt, Artificial Sequence
  source: /note="Description of Artificial Sequence: Synthetic oligonucleotide"
gugguggaccccaagcuuu

SEQ ID NO: 458 - RNA, 19 nt, Artificial Sequence
  source: /note="Description of Artificial Sequence: Synthetic oligonucleotide"
ugguggaccccaagcuuua

SEQ ID NO: 459 - RNA, 19 nt, Artificial Sequence
  source: /note="Description of Artificial Sequence: Synthetic oligonucleotide"
uggaccccaagcuuuagua

SEQ ID NO: 460 - RNA, 19 nt, Artificial Sequence
  source: /note="Description of Artificial Sequence: Synthetic oligonucleotide"
ggaccccaagcuuuaguaa

SEQ ID NO: 461 - RNA, 19 nt, Artificial Sequence
  source: /note="Description of Artificial Sequence: Synthetic oligonucleotide"
gaccccaagcuuuaguaaa

SEQ ID NO: 462 - RNA, 19 nt, Artificial Sequence
  source: /note="Description of Artificial Sequence: Synthetic oligonucleotide"
accccaagcuuuaguaaau

SEQ ID NO: 463 - RNA, 19 nt, Artificial Sequence
  source: /note="Description of Artificial Sequence: Synthetic oligonucleotide"
ccccaagcuuuaguaaaua

SEQ ID NO: 464 - RNA, 19 nt, Artificial Sequence
  source: /note="Description of Artificial Sequence: Synthetic oligonucleotide"
cccaagcuuuaguaaauau

SEQ ID NO: 465 - RNA, 19 nt, Artificial Sequence
  source: /note="Description of Artificial Sequence: Synthetic oligonucleotide"
ccaagcuuuaguaaauaua

SEQ ID NO: 466 - RNA, 19 nt, Artificial Sequence
  source: /note="Description of Artificial Sequence: Synthetic oligonucleotide"
uaaauauaaugaggaccua

SEQ ID NO: 467 - RNA, 19 nt, Artificial Sequence
  source: /note="Description of Artificial Sequence: Synthetic oligonucleotide"
aaauauaaugaggaccuau

SEQ ID NO: 468 - RNA, 19 nt, Artificial Sequence
  source: /note="Description of Artificial Sequence: Synthetic oligonucleotide"
aauauaaugaggaccuaua

SEQ ID NO: 469 - RNA, 19 nt, Artificial Sequence
  source: /note="Description of Artificial Sequence: Synthetic oligonucleotide"
auaaugaggaccuauacuu

SEQ ID NO: 470 - RNA, 19 nt, Artificial Sequence
  source: /note="Description of Artificial Sequence: Synthetic oligonucleotide"
aaacuacuguggaccacaa

SEQ ID NO: 471 - RNA, 19 nt, Artificial Sequence
  source: /note="Description of Artificial Sequence: Synthetic oligonucleotide"
ccacaagcagagugcugaa

SEQ ID NO: 472 - RNA, 19 nt, Artificial Sequence
  source: /note="Description of Artificial Sequence: Synthetic oligonucleotide"
cagagugcugaaggugcua

SEQ ID NO: 473 - RNA, 19 nt, Artificial Sequence
  source: /note="Description of Artificial Sequence: Synthetic oligonucleotide"
agagugcugaaggugcuau

SEQ ID NO: 474 - RNA, 19 nt, Artificial Sequence
  source: /note="Description of Artificial Sequence: Synthetic oligonucleotide"
auuguagaagcugguggaa

SEQ ID NO: 475 - RNA, 19 nt, Artificial Sequence
  source: /note="Description of Artificial Sequence: Synthetic oligonucleotide"
uuguagaagcugguggaau

SEQ ID NO: 476 - RNA, 19 nt, Artificial Sequence
  source: /note="Description of Artificial Sequence: Synthetic oligonucleotide"
gcugguggaaugcaagcuu

SEQ ID NO: 477 - RNA, 19 nt, Artificial Sequence
  source: /note="Description of Artificial Sequence: Synthetic oligonucleotide"
cugguggaaugcaagcuuu

SEQ ID NO: 478 - RNA, 19 nt, Artificial Sequence
  source: /note="Description of Artificial Sequence: Synthetic oligonucleotide"
aggacuucaccugacagau

SEQ ID NO: 479 - RNA, 19 nt, Artificial Sequence
  source: /note="Description of Artificial Sequence: Synthetic oligonucleotide"
cuucaccugacagauccaa

SEQ ID NO: 480 - RNA, 19 nt, Artificial Sequence
  source: /note="Description of Artificial Sequence: Synthetic oligonucleotide"
ccugacagauccaagucaa

SEQ ID NO: 481 - RNA, 19 nt, Artificial Sequence
  source: /note="Description of Artificial Sequence: Synthetic oligonucleotide"
agauccaagucaacgucuu

SEQ ID NO: 482 - RNA, 19 nt, Artificial Sequence
  source: /note="Description of Artificial Sequence: Synthetic oligonucleotide"
uccaagucaacgucuuguu

SEQ ID NO: 483 - RNA, 19 nt, Artificial Sequence
  source: /note="Description of Artificial Sequence: Synthetic oligonucleotide"
ucuuguucagaacugucuu

SEQ ID NO: 484 - RNA, 19 nt, Artificial Sequence
  source: /note="Description of Artificial Sequence: Synthetic oligonucleotide"
cuuguucagaacugucuuu

SEQ ID NO: 485 - RNA, 19 nt, Artificial Sequence
  source: /note="Description of Artificial Sequence: Synthetic oligonucleotide"
gucuuuggacucucaggaa

SEQ ID NO: 486 - RNA, 19 nt, Artificial Sequence
  source: /note="Description of Artificial Sequence: Synthetic oligonucleotide"
ucuuuggacucucaggaau

SEQ ID NO: 487 - RNA, 19 nt, Artificial Sequence
  source: /note="Description of Artificial Sequence: Synthetic oligonucleotide"
uuggacucucaggaaucuu

SEQ ID NO: 488 - RNA, 19 nt, Artificial Sequence
  source: /note="Description of Artificial Sequence: Synthetic oligonucleotide"
ugcccagggagaaccccuu

SEQ ID NO: 489 - RNA, 19 nt, Artificial Sequence
  source: /note="Description of Artificial Sequence: Synthetic oligonucleotide"
uggacucucaggaaucuuu

SEQ ID NO: 490 - RNA, 19 nt, Artificial Sequence
  source: /note="Description of Artificial Sequence: Synthetic oligonucleotide"
ucucaggaaucuuucagau

SEQ ID NO: 491 - RNA, 19 nt, Artificial Sequence
  source: /note="Description of Artificial Sequence: Synthetic oligonucleotide"
aaucuuucagaugcugcaa

SEQ ID NO: 492 - RNA, 19 nt, Artificial Sequence
  source: /note="Description of Artificial Sequence: Synthetic oligonucleotide"
cuuucagaugcugcaacua

SEQ ID NO: 493 - RNA, 19 nt, Artificial Sequence
  source: /note="Description of Artificial Sequence: Synthetic oligonucleotide"
uucagaugcugcaacuaaa

SEQ ID NO: 494 - RNA, 19 nt, Artificial Sequence
  source: /note="Description of Artificial Sequence: Synthetic oligonucleotide"
ugcugcaacuaaacaggaa

SEQ ID NO: 495 - RNA, 19 nt, Artificial Sequence
  source: /note="Description of Artificial Sequence: Synthetic oligonucleotide"
uaaacaggaagggauggaa

SEQ ID NO: 496 - RNA, 19 nt, Artificial Sequence
  source: /note="Description of Artificial Sequence: Synthetic oligonucleotide"
agggauggaaggucuccuu

SEQ ID NO: 497 - RNA, 19 nt, Artificial Sequence
  source: /note="Description of Artificial Sequence: Synthetic oligonucleotide"
aggucuccuugggacucuu

SEQ ID NO: 498 - RNA, 19 nt, Artificial Sequence
  source: /note="Description of Artificial Sequence: Synthetic oligonucleotide"
ucuccuugggacucuuguu

SEQ ID NO: 499 - RNA, 19 nt, Artificial Sequence
  source: /note="Description of Artificial Sequence: Synthetic oligonucleotide"
ugggacucuuguucagcuu

SEQ ID NO: 500 - RNA, 19 nt, Artificial Sequence
  source: /note="Description of Artificial Sequence: Synthetic oligonucleotide"
cuuguucagcuucuggguu

SEQ ID NO: 501 - RNA, 19 nt, Artificial Sequence
  source: /note="Description of Artificial Sequence: Synthetic oligonucleotide"
ucagcuucuggguucagau

SEQ ID NO: 502 - RNA, 19 nt, Artificial Sequence
  source: /note="Description of Artificial Sequence: Synthetic oligonucleotide"
gcuucuggguucagaugau

SEQ ID NO: 503 - RNA, 19 nt, Artificial Sequence
  source: /note="Description of Artificial Sequence: Synthetic oligonucleotide"
cuucuggguucagaugaua

SEQ ID NO: 504 - RNA, 19 nt, Artificial Sequence
  source: /note="Description of Artificial Sequence: Synthetic oligonucleotide"
ggccaggaugccuugggua

SEQ ID NO: 505 - RNA, 19 nt, Artificial Sequence
  source: /note="Description of Artificial Sequence: Synthetic oligonucleotide"
uucuggguucagaugauau

SEQ ID NO: 506 - RNA, 19 nt, Artificial Sequence
  source: /note="Description of Artificial Sequence: Synthetic oligonucleotide"
cuggguucagaugauauaa

SEQ ID NO: 507 - RNA, 19 nt, Artificial Sequence
  source: /note="Description of Artificial Sequence: Synthetic oligonucleotide"
uggguucagaugauauaaa

SEQ ID NO: 508 - RNA, 19 nt, Artificial Sequence
  source: /note="Description of Artificial Sequence: Synthetic oligonucleotide"
gucaccugugcagcuggaa

SEQ ID NO: 509 - RNA, 19 nt, Artificial Sequence
  source: /note="Description of Artificial Sequence: Synthetic oligonucleotide"
ucaccugugcagcuggaau

SEQ ID NO: 510 - RNA, 19 nt, Artificial Sequence
  source: /note="Description of Artificial Sequence: Synthetic oligonucleotide"
caccugugcagcuggaauu

SEQ ID NO: 511 - RNA, 19 nt, Artificial Sequence
  source: /note="Description of Artificial Sequence: Synthetic oligonucleotide"
cugugcagcuggaauucuu

SEQ ID NO: 512 - RNA, 19 nt, Artificial Sequence
  source: /note="Description of Artificial Sequence: Synthetic oligonucleotide"
ugugcagcuggaauucuuu

SEQ ID NO: 513 - RNA, 19 nt, Artificial Sequence
  source: /note="Description of Artificial Sequence: Synthetic oligonucleotide"
gcagcuggaauucuuucua

SEQ ID NO: 514 - RNA, 19 nt, Artificial Sequence
  source: /note="Description of Artificial Sequence: Synthetic oligonucleotide"
cagcuggaauucuuucuaa

SEQ ID NO: 515 - RNA, 19 nt, Artificial Sequence
  source: /note="Description of Artificial Sequence: Synthetic oligonucleotide"
uuucuaaccucacuugcaa

SEQ ID NO: 516 - RNA, 19 nt, Artificial Sequence
  source: /note="Description of Artificial Sequence: Synthetic oligonucleotide"
uucuaaccucacuugcaau

SEQ ID NO: 517 - RNA, 19 nt, Artificial Sequence
  source: /note="Description of Artificial Sequence: Synthetic oligonucleotide"
accucacuugcaauaauua

SEQ ID NO: 518 - RNA, 19 nt, Artificial Sequence
  source: /note="Description of Artificial Sequence: Synthetic oligonucleotide"
ccucacuugcaauaauuau

SEQ ID NO: 519 - RNA, 19 nt, Artificial Sequence
  source: /note="Description of Artificial Sequence: Synthetic oligonucleotide"
cucacuugcaauaauuaua

SEQ ID NO: 520 - RNA, 19 nt, Artificial Sequence
  source: /note="Description of Artificial Sequence: Synthetic oligonucleotide"
gucugccaaguggguggua

SEQ ID NO: 521 - RNA, 19 nt, Artificial Sequence
  source: /note="Description of Artificial Sequence: Synthetic oligonucleotide"
ucugccaagugggugguau

SEQ ID NO: 522 - RNA, 19 nt, Artificial Sequence
  source: /note="Description of Artificial Sequence: Synthetic oligonucleotide"
gggugguauagaggcucuu

SEQ ID NO: 523 - RNA, 19 nt, Artificial Sequence
  source: /note="Description of Artificial Sequence: Synthetic oligonucleotide"
auagaggcucuugugcgua

SEQ ID NO: 524 - RNA, 19 nt, Artificial Sequence
  source: /note="Description of Artificial Sequence: Synthetic oligonucleotide"
ucuugugcguacuguccuu

SEQ ID NO: 525 - RNA, 19 nt, Artificial Sequence
  source: /note="Description of Artificial Sequence: Synthetic oligonucleotide"
cuggugacagggaagacau

SEQ ID NO: 526 - RNA, 19 nt, Artificial Sequence
  source: /note="Description of Artificial Sequence: Synthetic oligonucleotide"
acaucacugagccugccau

SEQ ID NO: 527 - RNA, 19 nt, Artificial Sequence
  source: /note="Description of Artificial Sequence: Synthetic oligonucleotide"
gccugccaucugugcucuu

SEQ ID NO: 528 - RNA, 19 nt, Artificial Sequence
  source: /note="Description of Artificial Sequence: Synthetic oligonucleotide"
ucugaccagccgacaccaa

SEQ ID NO: 529 - RNA, 19 nt, Artificial Sequence
  source: /note="Description of Artificial Sequence: Synthetic oligonucleotide"
gaccagccgacaccaagaa

SEQ ID NO: 530 - RNA, 19 nt, Artificial Sequence
  source: /note="Description of Artificial Sequence: Synthetic oligonucleotide"
gacaccaagaagcagagau

SEQ ID NO: 531 - RNA, 19 nt, Artificial Sequence
  source: /note="Description of Artificial Sequence: Synthetic oligonucleotide"
agcagagauggcccagaau

SEQ ID NO: 532 - RNA, 19 nt, Artificial Sequence
  source: /note="Description of Artificial Sequence: Synthetic oligonucleotide"
gauggcccagaaugcaguu

SEQ ID NO: 533 - RNA, 19 nt, Artificial Sequence
  source: /note="Description of Artificial Sequence: Synthetic oligonucleotide"
ccagaaugcaguucgccuu

SEQ ID NO: 534 - RNA, 19 nt, Artificial Sequence
  source: /note="Description of Artificial Sequence: Synthetic oligonucleotide"
augcaguucgccuucacua

SEQ ID NO: 535 - RNA, 19 nt, Artificial Sequence
  source: /note="Description of Artificial Sequence: Synthetic oligonucleotide"
ugcaguucgccuucacuau

SEQ ID NO: 536 - RNA, 19 nt, Artificial Sequence
  source: /note="Description of Artificial Sequence: Synthetic oligonucleotide"
ucgccuucacuauggacua

SEQ ID NO: 537 - RNA, 19 nt, Artificial Sequence
  source: /note="Description of Artificial Sequence: Synthetic oligonucleotide"
ucacuauggacuaccaguu

SEQ ID NO: 538 - RNA, 19 nt, Artificial Sequence
  source: /note="Description of Artificial Sequence: Synthetic oligonucleotide"
uggacuaccaguugugguu

SEQ ID NO: 539 - RNA, 19 nt, Artificial Sequence
  source: /note="Description of Artificial Sequence: Synthetic oligonucleotide"
ggacuaccaguugugguua

SEQ ID NO: 540 - RNA, 19 nt, Artificial Sequence
  source: /note="Description of Artificial Sequence: Synthetic oligonucleotide"
gacuaccaguugugguuaa

SEQ ID NO: 541 - RNA, 19 nt, Artificial Sequence
  source: /note="Description of Artificial Sequence: Synthetic oligonucleotide"
caguugugguuaagcucuu

SEQ ID NO: 542 - RNA, 19 nt, Artificial Sequence
  source: /note="Description of Artificial Sequence: Synthetic oligonucleotide"
aguugugguuaagcucuua

SEQ ID NO: 543 - RNA, 19 nt, Artificial Sequence
  source: /note="Description of Artificial Sequence: Synthetic oligonucleotide"
aagcucuuacacccaccau

SEQ ID NO: 544 - RNA, 19 nt, Artificial Sequence
  source: /note="Description of Artificial Sequence: Synthetic oligonucleotide"
caucccacuggccucugau

SEQ ID NO: 545 - RNA, 19 nt, Artificial Sequence
  source: /note="Description of Artificial Sequence: Synthetic oligonucleotide"
aucccacuggccucugaua

SEQ ID NO: 546 - RNA, 19 nt, Artificial Sequence
  source: /note="Description of Artificial Sequence: Synthetic oligonucleotide"
ucccacuggccucugauaa

SEQ ID NO: 547 - RNA, 19 nt, Artificial Sequence
  source: /note="Description of Artificial Sequence: Synthetic oligonucleotide"
uggccucugauaaaggcua

SEQ ID NO: 548 - RNA, 19 nt, Artificial Sequence
  source: /note="Description of Artificial Sequence: Synthetic oligonucleotide"
ucugauaaaggcuacuguu

SEQ ID NO: 549 - RNA, 19 nt, Artificial Sequence
  source: /note="Description of Artificial Sequence: Synthetic oligonucleotide"
auaaaggcuacuguuggau

SEQ ID NO: 550 - RNA, 19 nt, Artificial Sequence
  source: /note="Description of Artificial Sequence: Synthetic oligonucleotide"
ggcuacuguuggauugauu

SEQ ID NO: 551 - RNA, 19 nt, Artificial Sequence
  source: /note="Description of Artificial Sequence: Synthetic oligonucleotide"
uguuggauugauucgaaau

SEQ ID NO: 552 - RNA, 19 nt, Artificial Sequence
  source: /note="Description of Artificial Sequence: Synthetic oligonucleotide"
ugccauuccacgacuaguu

SEQ ID NO: 553 - RNA, 19 nt, Artificial Sequence
  source: /note="Description of Artificial Sequence: Synthetic oligonucleotide"
uuccacgacuaguucaguu

SEQ ID NO: 554 - RNA, 19 nt, Artificial Sequence
  source: /note="Description of Artificial Sequence: Synthetic oligonucleotide"
acgacuaguucaguugcuu

SEQ ID NO: 555 - RNA, 19 nt, Artificial Sequence
  source: /note="Description of Artificial Sequence: Synthetic oligonucleotide"
acuaguucaguugcuuguu

SEQ ID NO: 556 - RNA, 19 nt, Artificial Sequence
  source: /note="Description of Artificial Sequence: Synthetic oligonucleotide"
guugcuuguucgugcacau

SEQ ID NO: 557 - RNA, 19 nt, Artificial Sequence
  source: /note="Description of Artificial Sequence: Synthetic oligonucleotide"
uguucgugcacaucaggau

SEQ ID NO: 558 - RNA, 19 nt, Artificial Sequence
  source: /note="Description of Artificial Sequence: Synthetic oligonucleotide"
guucgugcacaucaggaua

SEQ ID NO: 559 - RNA, 19 nt, Artificial Sequence
  source: /note="Description of Artificial Sequence: Synthetic oligonucleotide"
ggugggacacagcagcaau

SEQ ID NO: 560 - RNA, 19 nt, Artificial Sequence
  source: /note="Description of Artificial Sequence: Synthetic oligonucleotide"
gugggacacagcagcaauu

SEQ ID NO: 561 - RNA, 19 nt, Artificial Sequence
  source: /note="Description of Artificial Sequence: Synthetic oligonucleotide"
ugggacacagcagcaauuu

SEQ ID NO: 562 - RNA, 19 nt, Artificial Sequence
  source: /note="Description of Artificial Sequence: Synthetic oligonucleotide"
gggguccgcauggaagaaa

SEQ ID NO: 563 - RNA, 19 nt, Artificial Sequence
  source: /note="Description of Artificial Sequence: Synthetic oligonucleotide"
ggguccgcauggaagaaau

SEQ ID NO: 564 - RNA, 19 nt, Artificial Sequence
  source: /note="Description of Artificial Sequence: Synthetic oligonucleotide"
ucacauccuagcucgggau

SEQ ID NO: 565 - RNA, 19 nt, Artificial Sequence
  source: /note="Description of Artificial Sequence: Synthetic oligonucleotide"
cauccuagcucgggauguu

SEQ ID NO: 566 - RNA, 19 nt, Artificial Sequence
  source: /note="Description of Artificial Sequence: Synthetic oligonucleotide"
uagcucgggauguucacaa

SEQ ID NO: 567 - RNA, 19 nt, Artificial Sequence
  source: /note="Description of Artificial Sequence: Synthetic oligonucleotide"
gggauguucacaaccgaau

SEQ ID NO: 568 - RNA, 19 nt, Artificial Sequence
  source: /note="Description of Artificial Sequence: Synthetic oligonucleotide"
ggauguucacaaccgaauu

SEQ ID NO: 569 - RNA, 19 nt, Artificial Sequence
  source: /note="Description of Artificial Sequence: Synthetic oligonucleotide"
cagaggacuaaauaccauu

SEQ ID NO: 570 - RNA, 19 nt, Artificial Sequence
  source: /note="Description of Artificial Sequence: Synthetic oligonucleotide"
ggacuaaauaccauuccau

SEQ ID NO: 571 - RNA, 19 nt, Artificial Sequence
  source: /note="Description of Artificial Sequence: Synthetic oligonucleotide"
uaaauaccauuccauuguu

SEQ ID NO: 572 - RNA, 19 nt, Artificial Sequence
  source: /note="Description of Artificial Sequence: Synthetic oligonucleotide"
aaauaccauuccauuguuu

SEQ ID NO: 573 - RNA, 19 nt, Artificial Sequence
  source: /note="Description of Artificial Sequence: Synthetic oligonucleotide"
auuguuugugcagcugcuu

SEQ ID NO: 574 - RNA, 19 nt, Artificial Sequence
  source: /note="Description of Artificial Sequence: Synthetic oligonucleotide"
uuguuugugcagcugcuuu

SEQ ID NO: 575 - RNA, 19 nt, Artificial Sequence
  source: /note="Description of Artificial Sequence: Synthetic oligonucleotide"
uguuugugcagcugcuuua

SEQ ID NO: 576 - RNA, 19 nt, Artificial Sequence
  source: /note="Description of Artificial Sequence: Synthetic oligonucleotide"
guuugugcagcugcuuuau

SEQ ID NO: 577 - RNA, 19 nt, Artificial Sequence
  source: /note="Description of Artificial Sequence: Synthetic oligonucleotide"
uuugugcagcugcuuuauu

SEQ ID NO: 578 - RNA, 19 nt, Artificial Sequence
  source: /note="Description of Artificial Sequence: Synthetic oligonucleotide"
agcugcuuuauucucccau

SEQ ID NO: 579 - RNA, 19 nt, Artificial Sequence
  source: /note="Description of Artificial Sequence: Synthetic oligonucleotide"
gcugcuuuauucucccauu

SEQ ID NO: 580 - RNA, 19 nt, Artificial Sequence
  source: /note="Description of Artificial Sequence: Synthetic oligonucleotide"
uuuauucucccauugaaaa

SEQ ID NO: 581 - RNA, 19 nt, Artificial Sequence
  source: /note="Description of Artificial Sequence: Synthetic oligonucleotide"
auucucccauugaaaacau

SEQ ID NO: 582 - RNA, 19 nt, Artificial Sequence
  source: /note="Description of Artificial Sequence: Synthetic oligonucleotide"
ucccauugaaaacauccaa

SEQ ID NO: 583 - RNA, 19 nt, Artificial Sequence
  source: /note="Description of Artificial Sequence: Synthetic oligonucleotide"
ugcagggguccucugugaa

SEQ ID NO: 584 - RNA, 19 nt, Artificial Sequence
  source: /note="Description of Artificial Sequence: Synthetic oligonucleotide"
acuugcucaggacaaggaa

SEQ ID NO: 585 - RNA, 19 nt, Artificial Sequence
  source: /note="Description of Artificial Sequence: Synthetic oligonucleotide"
cagcuccucugacagaguu

SEQ ID NO: 586 - RNA, 19 nt, Artificial Sequence
  source: /note="Description of Artificial Sequence: Synthetic oligonucleotide"
agcuccucugacagaguua

SEQ ID NO: 587 - RNA, 19 nt, Artificial Sequence
  source: /note="Description of Artificial Sequence: Synthetic oligonucleotide"
uccucugacagaguuacuu

SEQ ID NO: 588 - RNA, 19 nt, Artificial Sequence
  source: /note="Description of Artificial Sequence: Synthetic oligonucleotide"
acagaguuacuucacucua

SEQ ID NO: 589 - RNA, 19 nt, Artificial Sequence
  source: /note="Description of Artificial Sequence: Synthetic oligonucleotide"
aguuacuucacucuaggaa

SEQ ID NO: 590 - RNA, 19 nt, Artificial Sequence
  source: /note="Description of Artificial Sequence: Synthetic oligonucleotide"
guuacuucacucuaggaau

SEQ ID NO: 591 - RNA, 19 nt, Artificial Sequence
  source: /note="Description of Artificial Sequence: Synthetic oligonucleotide"
acuucacucuaggaaugaa

SEQ ID NO: 592 - RNA, 19 nt, Artificial Sequence
  source: /note="Description of Artificial Sequence: Synthetic oligonucleotide"
gcugcuguuuuguuccgaa

SEQ ID NO: 593 - RNA, 19 nt, Artificial Sequence
  source: /note="Description of Artificial Sequence: Synthetic oligonucleotide"
cugcuguuuuguuccgaau

SEQ ID NO: 594 - RNA, 19 nt, Artificial Sequence
  source: /note="Description of Artificial Sequence: Synthetic oligonucleotide"
gucugaggacaagccacaa

SEQ ID NO: 595 - RNA, 19 nt, Artificial Sequence
  source: /note="Description of Artificial Sequence: Synthetic oligonucleotide"
ugaggacaagccacaagau

SEQ ID NO: 596 - RNA, 19 nt, Artificial Sequence
  source: /note="Description of Artificial Sequence: Synthetic oligonucleotide"
acaagccacaagauuacaa

SEQ ID NO: 597 - RNA, 19 nt, Artificial Sequence
  source: /note="Description of Artificial Sequence: Synthetic oligonucleotide"
agccacaagauuacaagaa

SEQ ID NO: 598 - RNA, 19 nt, Artificial Sequence
  source: /note="Description of Artificial Sequence: Synthetic oligonucleotide"
agauuacaagaaacggcuu

SEQ ID NO: 599 - RNA, 19 nt, Artificial Sequence
  source: /note="Description of Artificial Sequence: Synthetic oligonucleotide"
caagaaacggcuuucaguu

SEQ ID NO: 600 - RNA, 19 nt, Artificial Sequence
  source: /note="Description of Artificial Sequence: Synthetic oligonucleotide"
agcugaccagcucucucuu

SEQ ID NO: 601 - RNA, 19 nt, Artificial Sequence
  source: /note="Description of Artificial Sequence: Synthetic oligonucleotide"
accagcucucucuucagaa

SEQ ID NO: 602 - RNA, 19 nt, Artificial Sequence
  source: /note="Description of Artificial Sequence: Synthetic oligonucleotide"
uauuggugcccagggagaa

SEQ ID NO: 603 - RNA, 19 nt, Artificial Sequence
  source: /note="Description of Artificial Sequence: Synthetic oligonucleotide"
cagggagaaccccuuggau

SEQ ID NO: 604 - RNA, 19 nt, Artificial Sequence
  source: /note="Description of Artificial Sequence: Synthetic oligonucleotide"
agggagaaccccuuggaua

SEQ ID NO: 605 - RNA, 19 nt, Artificial Sequence
  source: /note="Description of Artificial Sequence: Synthetic oligonucleotide"
ccuuggauaucgccaggau

SEQ ID NO: 606 - RNA, 19 nt, Artificial Sequence
  source: /note="Description of Artificial Sequence: Synthetic oligonucleotide"
uaucgccaggaugauccua

SEQ ID NO: 607 - RNA, 19 nt, Artificial Sequence
  source: /note="Description of Artificial Sequence: Synthetic oligonucleotide"
gccaggaugauccuagcua

SEQ ID NO: 608 - RNA, 19 nt, Artificial Sequence
  source: /note="Description of Artificial Sequence: Synthetic oligonucleotide"
ccaggaugauccuagcuau

SEQ ID NO: 609 - RNA, 19 nt, Artificial Sequence
  source: /note="Description of Artificial Sequence: Synthetic oligonucleotide"
gaugauccuagcuaucguu

SEQ ID NO: 610 - RNA, 19 nt, Artificial Sequence
  source: /note="Description of Artificial Sequence: Synthetic oligonucleotide"
auccuagcuaucguucuuu

SEQ ID NO: 611 - RNA, 19 nt, Artificial Sequence
  source: /note="Description of Artificial Sequence: Synthetic oligonucleotide"
uccuagcuaucguucuuuu

SEQ ID NO: 612 - RNA, 19 nt, Artificial Sequence
  source: /note="Description of Artificial Sequence: Synthetic oligonucleotide"
ucuuuucacucugguggau

SEQ ID NO: 613 - RNA, 19 nt, Artificial Sequence
  source: /note="Description of Artificial Sequence: Synthetic oligonucleotide"
cuuuucacucugguggaua

SEQ ID NO: 614 - RNA, 19 nt, Artificial Sequence
  source: /note="Description of Artificial Sequence: Synthetic oligonucleotide"
uuuucacucugguggauau

SEQ ID NO: 615 - RNA, 19 nt, Artificial Sequence
  source: /note="Description of Artificial Sequence: Synthetic oligonucleotide"
ugguggauauggccaggau

SEQ ID NO: 616 - RNA, 19 nt, Artificial Sequence
  source: /note="Description of Artificial Sequence: Synthetic oligonucleotide"
gauauggccaggaugccuu

SEQ ID NO: 617 - RNA, 19 nt, Artificial Sequence
  source: /note="Description of Artificial Sequence: Synthetic oligonucleotide"
ccuuggguauggaccccau

SEQ ID NO: 618 - RNA, 19 nt, Artificial Sequence
  source: /note="Description of Artificial Sequence: Synthetic oligonucleotide"
uggguauggaccccaugau

SEQ ID NO: 619 - RNA, 19 nt, Artificial Sequence
  source: /note="Description of Artificial Sequence: Synthetic oligonucleotide"
uuguaaacuugauuaacua

SEQ ID NO: 620 - RNA, 19 nt, Artificial Sequence
  source: /note="Description of Artificial Sequence: Synthetic oligonucleotide"
uguaaacuugauuaacuau

SEQ ID NO: 621 - RNA, 19 nt, Artificial Sequence
  source: /note="Description of Artificial Sequence: Synthetic oligonucleotide"
aaacuugauuaacuaucaa

SEQ ID NO: 622 - RNA, 19 nt, Artificial Sequence
  source: /note="Description of Artificial Sequence: Synthetic oligonucleotide"
uauggaccccaugauggaa

SEQ ID NO: 623 - RNA, 19 nt, Artificial Sequence
  source: /note="Description of Artificial Sequence: Synthetic oligonucleotide"
ggaccccaugauggaacau

SEQ ID NO: 624 - RNA, 19 nt, Artificial Sequence
  source: /note="Description of Artificial Sequence: Synthetic oligonucleotide"
ccaugauggaacaugagau

SEQ ID NO: 625 - RNA, 19 nt, Artificial Sequence
  source: /note="Description of Artificial Sequence: Synthetic oligonucleotide"
accacccuggugcugacua

SEQ ID NO: 626 - RNA, 19 nt, Artificial Sequence
  source: /note="Description of Artificial Sequence: Synthetic oligonucleotide"
ccacccuggugcugacuau

SEQ ID NO: 627 - RNA, 19 nt, Artificial Sequence
  source: /note="Description of Artificial Sequence: Synthetic oligonucleotide"
ugcugacuauccaguugau

SEQ ID NO: 628 - RNA, 19 nt, Artificial Sequence
  source: /note="Description of Artificial Sequence: Synthetic oligonucleotide"
aguugaugggcugccagau

SEQ ID NO: 629 - RNA, 19 nt, Artificial Sequence
  source: /note="Description of Artificial Sequence: Synthetic oligonucleotide"
ugcccaggaccucauggau

SEQ ID NO: 630 - RNA, 19 nt, Artificial Sequence
  source: /note="Description of Artificial Sequence: Synthetic oligonucleotide"
gcaaucagcuggccugguu

SEQ ID NO: 631 - RNA, 19 nt, Artificial Sequence
  source: /note="Description of Artificial Sequence: Synthetic oligonucleotide"
caaucagcuggccugguuu

SEQ ID NO: 632 - RNA, 19 nt, Artificial Sequence
  source: /note="Description of Artificial Sequence: Synthetic oligonucleotide"
gguuugauacugaccugua

SEQ ID NO: 633 - RNA, 19 nt, Artificial Sequence
  source: /note="Description of Artificial Sequence: Synthetic oligonucleotide"
auacugaccuguaaaucau

SEQ ID NO: 634 - RNA, 19 nt, Artificial Sequence
  source: /note="Description of Artificial Sequence: Synthetic oligonucleotide"
ugaccuguaaaucauccuu

SEQ ID NO: 635 - RNA, 19 nt, Artificial Sequence
  source: /note="Description of Artificial Sequence: Synthetic oligonucleotide"
gaccuguaaaucauccuuu

SEQ ID NO: 636 - RNA, 19 nt, Artificial Sequence
  source: /note="Description of Artificial Sequence: Synthetic oligonucleotide"
accuguaaaucauccuuua

SEQ ID NO: 637 - RNA, 19 nt, Artificial Sequence
  source: /note="Description of Artificial Sequence: Synthetic oligonucleotide"
aauacaaaugauguagaaa

SEQ ID NO: 638 - RNA, 19 nt, Artificial Sequence
  source: /note="Description of Artificial Sequence: Synthetic oligonucleotide"
uuuuaagaauaucuguaau

SEQ ID NO: 639 - RNA, 19 nt, Artificial Sequence
  source: /note="Description of Artificial Sequence: Synthetic oligonucleotide"
uacagcaauuucuaauuuu

SEQ ID NO: 640 - RNA, 19 nt, Artificial Sequence
  source: /note="Description of Artificial Sequence: Synthetic oligonucleotide"
cacuaauucauaaucacuc

SEQ ID NO: 641 - RNA, 19 nt, Artificial Sequence
  source: /note="Description of Artificial Sequence: Synthetic oligonucleotide"
acuaauucauaaucacucu

SEQ ID NO: 642 - RNA, 19 nt, Artificial Sequence
  source: /note="Description of Artificial Sequence: Synthetic oligonucleotide"
uaauucauaaucacucuaa

SEQ ID NO: 643 - RNA, 19 nt, Artificial Sequence
  source: /note="Description of Artificial Sequence: Synthetic oligonucleotide"
aauucauaaucacucuaau

SEQ ID NO: 644 - RNA, 19 nt, Artificial Sequence
  source: /note="Description of Artificial Sequence: Synthetic oligonucleotide"
aauuguaaucugaauaaag

SEQ ID NO: 645 - RNA, 19 nt, Artificial Sequence
  source: /note="Description of Artificial Sequence: Synthetic oligonucleotide"
uuuguauaaaauagacaaa

SEQ ID NO: 646 - RNA, 19 nt, Artificial Sequence
  source: /note="Description of Artificial Sequence: Synthetic oligonucleotide"
uuguauaaaauagacaaau

SEQ ID NO: 647 - RNA, 19 nt, Artificial Sequence
  source: /note="Description of Artificial Sequence: Synthetic oligonucleotide"
uguauaaaauagacaaaua

SEQ ID NO: 648 - RNA, 19 nt, Artificial Sequence
  source: /note="Description of Artificial Sequence: Synthetic oligonucleotide"
guauaaaauagacaaauag

SEQ ID NO: 649 - RNA, 19 nt, Artificial Sequence
  source: /note="Description of Artificial Sequence: Synthetic oligonucleotide"
auaaaauagacaaauagaa

SEQ ID NO: 650 - RNA, 19 nt, Artificial Sequence
  source: /note="Description of Artificial Sequence: Synthetic oligonucleotide"
uaaaauagacaaauagaaa

SEQ ID NO: 651 - RNA, 19 nt, Artificial Sequence
  source: /note="Description of Artificial Sequence: Synthetic oligonucleotide"
aaauagacaaauagaaaau

SEQ ID NO: 652 - RNA, 19 nt, Artificial Sequence
  source: /note="Description of Artificial Sequence: Synthetic oligonucleotide"
ugggauauguauggguagg

SEQ ID NO: 653 - RNA, 19 nt, Artificial Sequence
  source: /note="Description of Artificial Sequence: Synthetic oligonucleotide"
gggauauguauggguaggg

SEQ ID NO: 654 - RNA, 19 nt, Artificial Sequence
  source: /note="Description of Artificial Sequence: Synthetic oligonucleotide"
cuaauucauaaucacucua

SEQ ID NO: 655 - RNA, 19 nt, Artificial Sequence
  source: /note="Description of Artificial Sequence: Synthetic oligonucleotide"
aaauagaaaaugguccaau

SEQ ID NO: 656 - RNA, 19 nt, Artificial Sequence
  source: /note="Description of Artificial Sequence: Synthetic oligonucleotide"
aauagaaaaugguccaauu

SEQ ID NO: 657 - RNA, 19 nt, Artificial Sequence
  source: /note="Description of Artificial Sequence: Synthetic oligonucleotide"
uuuggacaguuuaccaguu

SEQ ID NO: 658 - RNA, 19 nt, Artificial Sequence
  source: /note="Description of Artificial Sequence: Synthetic oligonucleotide"
auucuuucuaaccucacuu

SEQ ID NO: 659 - RNA, 19 nt, Artificial Sequence
  source: /note="Description of Artificial Sequence: Synthetic oligonucleotide"
uggauugauucgaaaucuu

SEQ ID NO: 660 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuggauagucagcaccatt

SEQ ID NO: 661 - RNA, 19 nt, Artificial Sequence
  source: /note="Description of Artificial Sequence: Synthetic oligonucleotide"
ugacgaagagcacagaugg

SEQ ID NO: 662 - RNA, 19 nt, Artificial Sequence
  source: /note="Description of Artificial Sequence: Synthetic oligonucleotide"
aauagauccaccugcuuau

SEQ ID NO: 663 - RNA, 19 nt, Artificial Sequence
  source: /note="Description of Artificial Sequence: Synthetic oligonucleotide"
cugcagcuacucuuuggau

SEQ ID NO: 664 - RNA, 19 nt, Artificial Sequence
  source: /note="Description of Artificial Sequence: Synthetic oligonucleotide"
agcuugaguagccauuguc

SEQ ID NO: 665 - RNA, 19 nt, Artificial Sequence
  source: /note="Description of Artificial Sequence: Synthetic oligonucleotide"
uuucgaaucaauccaacag

SEQ ID NO: 666 - RNA, 19 nt, Artificial Sequence
  source: /note="Description of Artificial Sequence: Synthetic oligonucleotide"
aguaucaaaccaggccagc

SEQ ID NO: 667 - RNA, 19 nt, Artificial Sequence
  source: /note="Description of Artificial Sequence: Synthetic oligonucleotide"
uauugcaagugagguuaga

SEQ ID NO: 668 - RNA, 19 nt, Artificial Sequence
  source: /note="Description of Artificial Sequence: Synthetic oligonucleotide"
ggaucauccuggcgauauc

SEQ ID NO: 669 - RNA, 19 nt, Artificial Sequence
  source: /note="Description of Artificial Sequence: Synthetic oligonucleotide"
ccagacuuaaagauggcca

SEQ ID NO: 670 - RNA, 19 nt, Artificial Sequence
  source: /note="Description of Artificial Sequence: Synthetic oligonucleotide"
uaugaauuaguguucuaca

SEQ ID NO: 671 - RNA, 19 nt, Artificial Sequence
  source: /note="Description of Artificial Sequence: Synthetic oligonucleotide"
aauaacaccucuuacugau

SEQ ID NO: 672 - RNA, 19 nt, Artificial Sequence
  source: /note="Description of Artificial Sequence: Synthetic oligonucleotide"
gucagaugacgaagagcac

SEQ ID NO: 673 - RNA, 19 nt, Artificial Sequence
  source: /note="Description of Artificial Sequence: Synthetic oligonucleotide"
acaggucaguaucaaacca

SEQ ID NO: 674 - RNA, 19 nt, Artificial Sequence
  source: /note="Description of Artificial Sequence: Synthetic oligonucleotide"
ugggauaaaaggcaacugg

SEQ ID NO: 675 - RNA, 19 nt, Artificial Sequence
  source: /note="Description of Artificial Sequence: Synthetic oligonucleotide"
aggucaguaucaaaccagg

SEQ ID NO: 676 - RNA, 19 nt, Artificial Sequence
  source: /note="Description of Artificial Sequence: Synthetic oligonucleotide"
gcccaucaacuggauaguc

SEQ ID NO: 677 - RNA, 19 nt, Artificial Sequence
  source: /note="Description of Artificial Sequence: Synthetic oligonucleotide"
ucauuccaagccauuggcu

SEQ ID NO: 678 - RNA, 19 nt, Artificial Sequence
  source: /note="Description of Artificial Sequence: Synthetic oligonucleotide"
cucauuccaagccauuggc

SEQ ID NO: 679 - RNA, 19 nt, Artificial Sequence
  source: /note="Description of Artificial Sequence: Synthetic oligonucleotide"
gaucugcaugcccucaucu

SEQ ID NO: 680 - RNA, 19 nt, Artificial Sequence
  source: /note="Description of Artificial Sequence: Synthetic oligonucleotide"
agcaaguucacagaggacc

SEQ ID NO: 681 - RNA, 19 nt, Artificial Sequence
  source: /note="Description of Artificial Sequence: Synthetic oligonucleotide"
aacaagcaaggcuaggguu

SEQ ID NO: 682 - RNA, 19 nt, Artificial Sequence
  source: /note="Description of Artificial Sequence: Synthetic oligonucleotide"
ugauuaugaauuaguguuc

SEQ ID NO: 683 - RNA, 19 nt, Artificial Sequence
  source: /note="Description of Artificial Sequence: Synthetic oligonucleotide"
agcaaggcuaggguuugau

SEQ ID NO: 684 - RNA, 19 nt, Artificial Sequence
  source: /note="Description of Artificial Sequence: Synthetic oligonucleotide"
gggauaaaaggcaacuggu

SEQ ID NO: 685 - RNA, 19 nt, Artificial Sequence
  source: /note="Description of Artificial Sequence: Synthetic oligonucleotide"
uuauugcaagugagguuag

SEQ ID NO: 686 - RNA, 19 nt, Artificial Sequence
  source: /note="Description of Artificial Sequence: Synthetic oligonucleotide"
cgcuggacauuagugggau

SEQ ID NO: 687 - RNA, 19 nt, Artificial Sequence
  source: /note="Description of Artificial Sequence: Synthetic oligonucleotide"
ccaucaacuggauagucag

SEQ ID NO: 688 - RNA, 19 nt, Artificial Sequence
  source: /note="Description of Artificial Sequence: Synthetic oligonucleotide"
gucaguaucaaaccaggcc

SEQ ID NO: 689 - RNA, 19 nt, Artificial Sequence
  source: /note="Description of Artificial Sequence: Synthetic oligonucleotide"
caccucuuacugauuuacc

SEQ ID NO: 690 - RNA, 19 nt, Artificial Sequence
  source: /note="Description of Artificial Sequence: Synthetic oligonucleotide"
ggucaguaucaaaccaggc

SEQ ID NO: 691 - RNA, 19 nt, Artificial Sequence
  source: /note="Description of Artificial Sequence: Synthetic oligonucleotide"
aguucacagaggaccccug

SEQ ID NO: 692 - RNA, 19 nt, Artificial Sequence
  source: /note="Description of Artificial Sequence: Synthetic oligonucleotide"
gcaccagaauggauuccag

SEQ ID NO: 693 - RNA, 19 nt, Artificial Sequence
  source: /note="Description of Artificial Sequence: Synthetic oligonucleotide"
gugguggccacccaucuca

SEQ ID NO: 694 - RNA, 19 nt, Artificial Sequence
  source: /note="Description of Artificial Sequence: Synthetic oligonucleotide"
ugaccacauuuauaucauc

SEQ ID NO: 695 - RNA, 19 nt, Artificial Sequence
  source: /note="Description of Artificial Sequence: Synthetic oligonucleotide"
ucaaugggagaauaaagca

SEQ ID NO: 696 - RNA, 19 nt, Artificial Sequence
  source: /note="Description of Artificial Sequence: Synthetic oligonucleotide"
caaggcuaggguuugauaa

SEQ ID NO: 697 - RNA, 19 nt, Artificial Sequence
  source: /note="Description of Artificial Sequence: Synthetic oligonucleotide"
cuuuaucagaggccagugg

SEQ ID NO: 698 - RNA, 19 nt, Artificial Sequence
  source: /note="Description of Artificial Sequence: Synthetic oligonucleotide"
auugcacguguggcaaguu

SEQ ID NO: 699 - RNA, 19 nt, Artificial Sequence
  source: /note="Description of Artificial Sequence: Synthetic oligonucleotide"
uggucagaugacgaagagc

SEQ ID NO: 700 - RNA, 19 nt, Artificial Sequence
  source: /note="Description of Artificial Sequence: Synthetic oligonucleotide"
aauccauuuguauuguuac

SEQ ID NO: 701 - RNA, 19 nt, Artificial Sequence
  source: /note="Description of Artificial Sequence: Synthetic oligonucleotide"
caaguucacagaggacccc

SEQ ID NO: 702 - RNA, 19 nt, Artificial Sequence
  source: /note="Description of Artificial Sequence: Synthetic oligonucleotide"
caagcaaggcuaggguuug

SEQ ID NO: 703 - RNA, 19 nt, Artificial Sequence
  source: /note="Description of Artificial Sequence: Synthetic oligonucleotide"
guguucuacaccauuacuc

SEQ ID NO: 704 - RNA, 19 nt, Artificial Sequence
  source: /note="Description of Artificial Sequence: Synthetic oligonucleotide"
aggcucagugaugucuucc

SEQ ID NO: 705 - RNA, 19 nt, Artificial Sequence
  source: /note="Description of Artificial Sequence: Synthetic oligonucleotide"
ggcucagugaugucuuccc

SEQ ID NO: 706 - RNA, 19 nt, Artificial Sequence
  source: /note="Description of Artificial Sequence: Synthetic oligonucleotide"
ugaauuaguguucuacacc

SEQ ID NO: 707 - RNA, 19 nt, Artificial Sequence
  source: /note="Description of Artificial Sequence: Synthetic oligonucleotide"
ggauaaaaggcaacuggua

SEQ ID NO: 708 - RNA, 19 nt, Artificial Sequence
  source: /note="Description of Artificial Sequence: Synthetic oligonucleotide"
gaucauccuggcgauaucc

SEQ ID NO: 709 - RNA, 19 nt, Artificial Sequence
  source: /note="Description of Artificial Sequence: Synthetic oligonucleotide"
acaagcaaggcuaggguuu

SEQ ID NO: 710 - RNA, 19 nt, Artificial Sequence
  source: /note="Description of Artificial Sequence: Synthetic oligonucleotide"
cuggucagaugacgaagag

SEQ ID NO: 711 - RNA, 19 nt, Artificial Sequence
  source: /note="Description of Artificial Sequence: Synthetic oligonucleotide"
cccaucaacuggauaguca

SEQ ID NO: 712 - RNA, 19 nt, Artificial Sequence
  source: /note="Description of Artificial Sequence: Synthetic oligonucleotide"
ccuucagcacucugcuugu

SEQ ID NO: 713 - RNA, 19 nt, Artificial Sequence
  source: /note="Description of Artificial Sequence: Synthetic oligonucleotide"
augacgaagagcacagaug

SEQ ID NO: 714 - RNA, 19 nt, Artificial Sequence
  source: /note="Description of Artificial Sequence: Synthetic oligonucleotide"
gucucauuccaagccauug

SEQ ID NO: 715 - RNA, 19 nt, Artificial Sequence
  source: /note="Description of Artificial Sequence: Synthetic oligonucleotide"
gccuuuaucagaggccagu

SEQ ID NO: 716 - RNA, 19 nt, Artificial Sequence
  source: /note="Description of Artificial Sequence: Synthetic oligonucleotide"
cuggacauuagugggauga

SEQ ID NO: 717 - RNA, 19 nt, Artificial Sequence
  source: /note="Description of Artificial Sequence: Synthetic oligonucleotide"
ugucuggaagcuuccuuuu

SEQ ID NO: 718 - RNA, 19 nt, Artificial Sequence
  source: /note="Description of Artificial Sequence: Synthetic oligonucleotide"
caccagagugaaaagaacg

SEQ ID NO: 719 - RNA, 19 nt, Artificial Sequence
  source: /note="Description of Artificial Sequence: Synthetic oligonucleotide"
agcagguuacaacaacuuu

SEQ ID NO: 720 - RNA, 19 nt, Artificial Sequence
  source: /note="Description of Artificial Sequence: Synthetic oligonucleotide"
cagcuugaguagccauugu

SEQ ID NO: 721 - RNA, 19 nt, Artificial Sequence
  source: /note="Description of Artificial Sequence: Synthetic oligonucleotide"
uggacauuagugggaugag

SEQ ID NO: 722 - RNA, 19 nt, Artificial Sequence
  source: /note="Description of Artificial Sequence: Synthetic oligonucleotide"
aaguucacagaggaccccu

SEQ ID NO: 723 - RNA, 19 nt, Artificial Sequence
  source: /note="Description of Artificial Sequence: Synthetic oligonucleotide"
gaaauagauccaccugcuu

SEQ ID NO: 724 - RNA, 19 nt, Artificial Sequence
  source: /note="Description of Artificial Sequence: Synthetic oligonucleotide"
cagcagguuacaacaacuu

SEQ ID NO: 725 - RNA, 19 nt, Artificial Sequence
  source: /note="Description of Artificial Sequence: Synthetic oligonucleotide"
ugaaauagauccaccugcu

SEQ ID NO: 726 - RNA, 19 nt, Artificial Sequence
  source: /note="Description of Artificial Sequence: Synthetic oligonucleotide"
gaugggaucugcaugcccu

SEQ ID NO: 727 - RNA, 19 nt, Artificial Sequence
  source: /note="Description of Artificial Sequence: Synthetic oligonucleotide"
guuuaauucugaaccauuu

SEQ ID NO: 728 - RNA, 19 nt, Artificial Sequence
  source: /note="Description of Artificial Sequence: Synthetic oligonucleotide"
cuuguccugagcaaguuca

SEQ ID NO: 729 - RNA, 19 nt, Artificial Sequence
  source: /note="Description of Artificial Sequence: Synthetic oligonucleotide"
gaccccugcagcuacucuu

SEQ ID NO: 730 - RNA, 19 nt, Artificial Sequence
  source: /note="Description of Artificial Sequence: Synthetic oligonucleotide"
uuuaucagaggccaguggg

SEQ ID NO: 731 - RNA, 19 nt, Artificial Sequence
  source: /note="Description of Artificial Sequence: Synthetic oligonucleotide"
caguaucaaaccaggccag

SEQ ID NO: 732 - RNA, 19 nt, Artificial Sequence
  source: /note="Description of Artificial Sequence: Synthetic oligonucleotide"
auuuacaggucaguaucaa

SEQ ID NO: 733 - RNA, 19 nt, Artificial Sequence
  source: /note="Description of Artificial Sequence: Synthetic oligonucleotide"
augaauuaguguucuacac

SEQ ID NO: 734 - RNA, 19 nt, Artificial Sequence
  source: /note="Description of Artificial Sequence: Synthetic oligonucleotide"
agcccaucaacuggauagu

SEQ ID NO: 735 - RNA, 19 nt, Artificial Sequence
  source: /note="Description of Artificial Sequence: Synthetic oligonucleotide"
uaacaccucuuacugauuu

SEQ ID NO: 736 - RNA, 19 nt, Artificial Sequence
  source: /note="Description of Artificial Sequence: Synthetic oligonucleotide"
augaaauagauccaccugc

SEQ ID NO: 737 - RNA, 19 nt, Artificial Sequence
  source: /note="Description of Artificial Sequence: Synthetic oligonucleotide"
acuggauagucagcaccag

SEQ ID NO: 738 - RNA, 19 nt, Artificial Sequence
  source: /note="Description of Artificial Sequence: Synthetic oligonucleotide"
uuguccugagcaaguucac

SEQ ID NO: 739 - RNA, 19 nt, Artificial Sequence
  source: /note="Description of Artificial Sequence: Synthetic oligonucleotide"
aaauaacaccucuuacuga

SEQ ID NO: 740 - RNA, 19 nt, Artificial Sequence
  source: /note="Description of Artificial Sequence: Synthetic oligonucleotide"
cugagcaaguucacagagg

SEQ ID NO: 741 - RNA, 19 nt, Artificial Sequence
  source: /note="Description of Artificial Sequence: Synthetic oligonucleotide"
ucugugaugguucagccaa

SEQ ID NO: 742 - RNA, 19 nt, Artificial Sequence
  source: /note="Description of Artificial Sequence: Synthetic oligonucleotide"
aucaaaccaggccagcuga

SEQ ID NO: 743 - RNA, 19 nt, Artificial Sequence
  source: /note="Description of Artificial Sequence: Synthetic oligonucleotide"
agaggaccccugcagcuac

SEQ ID NO: 744 - RNA, 19 nt, Artificial Sequence
  source: /note="Description of Artificial Sequence: Synthetic oligonucleotide"
cacugccauuuuagcuccu

SEQ ID NO: 745 - RNA, 19 nt, Artificial Sequence
  source: /note="Description of Artificial Sequence: Synthetic oligonucleotide"
cagucucauuccaagccau

SEQ ID NO: 746 - RNA, 19 nt, Artificial Sequence
  source: /note="Description of Artificial Sequence: Synthetic oligonucleotide"
ucauccuggcgauauccaa

SEQ ID NO: 747 - RNA, 19 nt, Artificial Sequence
  source: /note="Description of Artificial Sequence: Synthetic oligonucleotide"
aaaaguuuaauucugaacc

SEQ ID NO: 748 - RNA, 19 nt, Artificial Sequence
  source: /note="Description of Artificial Sequence: Synthetic oligonucleotide"
accucuuacugauuuaccc

SEQ ID NO: 749 - RNA, 19 nt, Artificial Sequence
  source: /note="Description of Artificial Sequence: Synthetic oligonucleotide"
acaaacaauggaaugguau

SEQ ID NO: 750 - RNA, 19 nt, Artificial Sequence
  source: /note="Description of Artificial Sequence: Synthetic oligonucleotide"
uucgaaucaauccaacagu

SEQ ID NO: 751 - RNA, 19 nt, Artificial Sequence
  source: /note="Description of Artificial Sequence: Synthetic oligonucleotide"
uccuuguccugagcaaguu

SEQ ID NO: 752 - RNA, 19 nt, Artificial Sequence
  source: /note="Description of Artificial Sequence: Synthetic oligonucleotide"
accugcuuauuuuaagcau

SEQ ID NO: 753 - RNA, 19 nt, Artificial Sequence
  source: /note="Description of Artificial Sequence: Synthetic oligonucleotide"
uuacaggucaguaucaaac

SEQ ID NO: 754 - RNA, 19 nt, Artificial Sequence
  source: /note="Description of Artificial Sequence: Synthetic oligonucleotide"
aguuuaauucugaaccauu

SEQ ID NO: 755 - RNA, 19 nt, Artificial Sequence
  source: /note="Description of Artificial Sequence: Synthetic oligonucleotide"
uuacaacaacuuugggaua

SEQ ID NO: 756 - RNA, 19 nt, Artificial Sequence
  source: /note="Description of Artificial Sequence: Synthetic oligonucleotide"
ucaaaccaggccagcugau

SEQ ID NO: 757 - RNA, 19 nt, Artificial Sequence
  source: /note="Description of Artificial Sequence: Synthetic oligonucleotide"
gaagagcacagauggcagg

SEQ ID NO: 758 - RNA, 19 nt, Artificial Sequence
  source: /note="Description of Artificial Sequence: Synthetic oligonucleotide"
uacaucauuuguauucugc

SEQ ID NO: 759 - RNA, 19 nt, Artificial Sequence
  source: /note="Description of Artificial Sequence: Synthetic oligonucleotide"
ccugcuuauuuuaagcaua

SEQ ID NO: 760 - RNA, 19 nt, Artificial Sequence
  source: /note="Description of Artificial Sequence: Synthetic oligonucleotide"
auagauccaccugcuuauu

SEQ ID NO: 761 - RNA, 19 nt, Artificial Sequence
  source: /note="Description of Artificial Sequence: Synthetic oligonucleotide"
ggugaccacauuuauauca

SEQ ID NO: 762 - RNA, 19 nt, Artificial Sequence
  source: /note="Description of Artificial Sequence: Synthetic oligonucleotide"
ucuuacugauuuacccuac

SEQ ID NO: 763 - RNA, 19 nt, Artificial Sequence
  source: /note="Description of Artificial Sequence: Synthetic oligonucleotide"
gcaaggcuaggguuugaua

SEQ ID NO: 764 - RNA, 19 nt, Artificial Sequence
  source: /note="Description of Artificial Sequence: Synthetic oligonucleotide"
acaacuuugggauaaaagg

SEQ ID NO: 765 - RNA, 19 nt, Artificial Sequence
  source: /note="Description of Artificial Sequence: Synthetic oligonucleotide"
cuuacugauuuacccuacc

SEQ ID NO: 766 - RNA, 19 nt, Artificial Sequence
  source: /note="Description of Artificial Sequence: Synthetic oligonucleotide"
gauuuacaggucaguauca

SEQ ID NO: 767 - RNA, 19 nt, Artificial Sequence
  source: /note="Description of Artificial Sequence: Synthetic oligonucleotide"
caucugugaugguucagcc

SEQ ID NO: 768 - RNA, 19 nt, Artificial Sequence
  source: /note="Description of Artificial Sequence: Synthetic oligonucleotide"
aucauccuggcgauaucca

SEQ ID NO: 769 - RNA, 19 nt, Artificial Sequence
  source: /note="Description of Artificial Sequence: Synthetic oligonucleotide"
gcuggucagaugacgaaga

SEQ ID NO: 770 - RNA, 19 nt, Artificial Sequence
  source: /note="Description of Artificial Sequence: Synthetic oligonucleotide"
cagaggaccccugcagcua

SEQ ID NO: 771 - RNA, 19 nt, Artificial Sequence
  source: /note="Description of Artificial Sequence: Synthetic oligonucleotide"
aucacagcagguuacaaca

SEQ ID NO: 772 - RNA, 19 nt, Artificial Sequence
  source: /note="Description of Artificial Sequence: Synthetic oligonucleotide"
auaacaccucuuacugauu

SEQ ID NO: 773 - RNA, 19 nt, Artificial Sequence
  source: /note="Description of Artificial Sequence: Synthetic oligonucleotide"
aucugugaugguucagcca

SEQ ID NO: 774 - RNA, 19 nt, Artificial Sequence
  source: /note="Description of Artificial Sequence: Synthetic oligonucleotide"
ugaauuaaaaguuuaauuc

SEQ ID NO: 775 - RNA, 19 nt, Artificial Sequence
  source: /note="Description of Artificial Sequence: Synthetic oligonucleotide"
aaguuuaauucugaaccau

SEQ ID NO: 776 - RNA, 19 nt, Artificial Sequence
  source: /note="Description of Artificial Sequence: Synthetic oligonucleotide"
gaauuaguguucuacacca

SEQ ID NO: 777 - RNA, 19 nt, Artificial Sequence
  source: /note="Description of Artificial Sequence: Synthetic oligonucleotide"
aauuaguguucuacaccau

SEQ ID NO: 778 - RNA, 19 nt, Artificial Sequence
  source: /note="Description of Artificial Sequence: Synthetic oligonucleotide"
gggaucugcaugcccucau

SEQ ID NO: 779 - RNA, 19 nt, Artificial Sequence
  source: /note="Description of Artificial Sequence: Synthetic oligonucleotide"
uaucacagcagguuacaac

SEQ ID NO: 780 - RNA, 19 nt, Artificial Sequence
  source: /note="Description of Artificial Sequence: Synthetic oligonucleotide"
caucaacuggauagucagc

SEQ ID NO: 781 - RNA, 19 nt, Artificial Sequence
  source: /note="Description of Artificial Sequence: Synthetic oligonucleotide"
aaauagauccaccugcuua

SEQ ID NO: 782 - RNA, 19 nt, Artificial Sequence
  source: /note="Description of Artificial Sequence: Synthetic oligonucleotide"
gauccaccugcuuauuuua

SEQ ID NO: 783 - RNA, 19 nt, Artificial Sequence
  source: /note="Description of Artificial Sequence: Synthetic oligonucleotide"
aggugaccacauuuauauc

SEQ ID NO: 784 - RNA, 19 nt, Artificial Sequence
  source: /note="Description of Artificial Sequence: Synthetic oligonucleotide"
caccuucagcacucugcuu

SEQ ID NO: 785 - RNA, 19 nt, Artificial Sequence
  source: /note="Description of Artificial Sequence: Synthetic oligonucleotide"
uguccugagcaaguucaca

SEQ ID NO: 786 - RNA, 19 nt, Artificial Sequence
  source: /note="Description of Artificial Sequence: Synthetic oligonucleotide"
gcuggacauuagugggaug

SEQ ID NO: 787 - RNA, 19 nt, Artificial Sequence
  source: /note="Description of Artificial Sequence: Synthetic oligonucleotide"
gcagguuacaacaacuuug

SEQ ID NO: 788 - RNA, 19 nt, Artificial Sequence
  source: /note="Description of Artificial Sequence: Synthetic oligonucleotide"
aacaccucuuacugauuua

SEQ ID NO: 789 - RNA, 19 nt, Artificial Sequence
  source: /note="Description of Artificial Sequence: Synthetic oligonucleotide"
agucucauuccaagccauu

SEQ ID NO: 790 - RNA, 19 nt, Artificial Sequence
  source: /note="Description of Artificial Sequence: Synthetic oligonucleotide"
gcaaguucacagaggaccc

SEQ ID NO: 791 - RNA, 19 nt, Artificial Sequence
  source: /note="Description of Artificial Sequence: Synthetic oligonucleotide"
uccauuuguauuguuacuc

SEQ ID NO: 792 - RNA, 19 nt, Artificial Sequence
  source: /note="Description of Artificial Sequence: Synthetic oligonucleotide"
uuaguguucuacaccauua

SEQ ID NO: 793 - RNA, 19 nt, Artificial Sequence
  source: /note="Description of Artificial Sequence: Synthetic oligonucleotide"
uugaguagccauuguccac

SEQ ID NO: 794 - RNA, 19 nt, Artificial Sequence
  source: /note="Description of Artificial Sequence: Synthetic oligonucleotide"
ugagaguccaaagacaguu

SEQ ID NO: 795 - RNA, 19 nt, Artificial Sequence
  source: /note="Description of Artificial Sequence: Synthetic oligonucleotide"
uggauagucagcaccaggg

SEQ ID NO: 796 - RNA, 19 nt, Artificial Sequence
  source: /note="Description of Artificial Sequence: Synthetic oligonucleotide"
caugaaauagauccaccug

SEQ ID NO: 797 - RNA, 19 nt, Artificial Sequence
  source: /note="Description of Artificial Sequence: Synthetic oligonucleotide"
ucaguaucaaaccaggcca

SEQ ID NO: 798 - RNA, 19 nt, Artificial Sequence
  source: /note="Description of Artificial Sequence: Synthetic oligonucleotide"
guaucaaaccaggccagcu

SEQ ID NO: 799 - RNA, 19 nt, Artificial Sequence
  source: /note="Description of Artificial Sequence: Synthetic oligonucleotide"
gacgaagagcacagauggc

SEQ ID NO: 800 - RNA, 19 nt, Artificial Sequence
  source: /note="Description of Artificial Sequence: Synthetic oligonucleotide"
cacaaacaauggaauggua

SEQ ID NO: 801 - RNA, 19 nt, Artificial Sequence
  source: /note="Description of Artificial Sequence: Synthetic oligonucleotide"
uccuggcgauauccaaggg

SEQ ID NO: 802 - RNA, 19 nt, Artificial Sequence
  source: /note="Description of Artificial Sequence: Synthetic oligonucleotide"
gcucagugaugucuucccu

SEQ ID NO: 803 - RNA, 19 nt, Artificial Sequence
  source: /note="Description of Artificial Sequence: Synthetic oligonucleotide"
uugcacguguggcaaguuc

SEQ ID NO: 804 - RNA, 19 nt, Artificial Sequence
  source: /note="Description of Artificial Sequence: Synthetic oligonucleotide"
uuuacaggucaguaucaaa

SEQ ID NO: 805 - RNA, 19 nt, Artificial Sequence
  source: /note="Description of Artificial Sequence: Synthetic oligonucleotide"
gguuacaacaacuuuggga

SEQ ID NO: 806 - RNA, 19 nt, Artificial Sequence
  source: /note="Description of Artificial Sequence: Synthetic oligonucleotide"
cuacaucauuuguauucug

SEQ ID NO: 807 - RNA, 19 nt, Artificial Sequence
  source: /note="Description of Artificial Sequence: Synthetic oligonucleotide"
acaugaaauagauccaccu

SEQ ID NO: 808 - RNA, 19 nt, Artificial Sequence
  source: /note="Description of Artificial Sequence: Synthetic oligonucleotide"
ggacauuagugggaugagc

SEQ ID NO: 809 - RNA, 19 nt, Artificial Sequence
  source: /note="Description of Artificial Sequence: Synthetic oligonucleotide"
cuggauagucagcaccagg

SEQ ID NO: 810 - RNA, 19 nt, Artificial Sequence
  source: /note="Description of Artificial Sequence: Synthetic oligonucleotide"
ggcaccagaauggauucca

SEQ ID NO: 811 - RNA, 19 nt, Artificial Sequence
  source: /note="Description of Artificial Sequence: Synthetic oligonucleotide"
cccauccaugagguccugg

SEQ ID NO: 812 - RNA, 19 nt, Artificial Sequence
  source: /note="Description of Artificial Sequence: Synthetic oligonucleotide"
aauuauugcaagugagguu

SEQ ID NO: 813 - RNA, 19 nt, Artificial Sequence
  source: /note="Description of Artificial Sequence: Synthetic oligonucleotide"
uugggauaaaaggcaacug

SEQ ID NO: 814 - RNA, 19 nt, Artificial Sequence
  source: /note="Description of Artificial Sequence: Synthetic oligonucleotide"
uuaugaauuaguguucuac

SEQ ID NO: 815 - RNA, 19 nt, Artificial Sequence
  source: /note="Description of Artificial Sequence: Synthetic oligonucleotide"
cagcccaucaacuggauag

SEQ ID NO: 816 - RNA, 19 nt, Artificial Sequence
  source: /note="Description of Artificial Sequence: Synthetic oligonucleotide"
ccuuuaucagaggccagug

SEQ ID NO: 817 - RNA, 19 nt, Artificial Sequence
  source: /note="Description of Artificial Sequence: Synthetic oligonucleotide"
cugagaguccaaagacagu

SEQ ID NO: 818 - RNA, 19 nt, Artificial Sequence
  source: /note="Description of Artificial Sequence: Synthetic oligonucleotide"
ucucauuccaagccauugg

SEQ ID NO: 819 - RNA, 19 nt, Artificial Sequence
  source: /note="Description of Artificial Sequence: Synthetic oligonucleotide"
ccaccugcuuauuuuaagc

SEQ ID NO: 820 - RNA, 19 nt, Artificial Sequence
  source: /note="Description of Artificial Sequence: Synthetic oligonucleotide"
gaugacgaagagcacagau

SEQ ID NO: 821 - RNA, 19 nt, Artificial Sequence
  source: /note="Description of Artificial Sequence: Synthetic oligonucleotide"
agguuacaacaacuuuggg

SEQ ID NO: 822 - RNA, 19 nt, Artificial Sequence
  source: /note="Description of Artificial Sequence: Synthetic oligonucleotide"
ggacguacggcgcugggua

SEQ ID NO: 823 - RNA, 19 nt, Artificial Sequence
  source: /note="Description of Artificial Sequence: Synthetic oligonucleotide"
ggagaacgcaugauagcgu

SEQ ID NO: 824 - RNA, 19 nt, Artificial Sequence
  source: /note="Description of Artificial Sequence: Synthetic oligonucleotide"
gcucacgcaaaggugcaug

SEQ ID NO: 825 - RNA, 19 nt, Artificial Sequence
  source: /note="Description of Artificial Sequence: Synthetic oligonucleotide"
gugaaggcgaacugcauuc

SEQ ID NO: 826 - RNA, 19 nt, Artificial Sequence
  source: /note="Description of Artificial Sequence: Synthetic oligonucleotide"
cuagucguggaauggcacc

SEQ ID NO: 827 - RNA, 19 nt, Artificial Sequence
  source: /note="Description of Artificial Sequence: Synthetic oligonucleotide"
cagugacuaacagccgcuu

SEQ ID NO: 828 - RNA, 19 nt, Artificial Sequence
  source: /note="Description of Artificial Sequence: Synthetic oligonucleotide"
ucguacccucugagcucga

SEQ ID NO: 829 - RNA, 19 nt, Artificial Sequence
  source: /note="Description of Artificial Sequence: Synthetic oligonucleotide"
gaacgcaugauagcguguc

SEQ ID NO: 830 - RNA, 19 nt, Artificial Sequence
  source: /note="Description of Artificial Sequence: Synthetic oligonucleotide"
aggagaacgcaugauagcg

SEQ ID NO: 831 - RNA, 19 nt, Artificial Sequence
  source: /note="Description of Artificial Sequence: Synthetic oligonucleotide"
uacguacaauagcagacac

SEQ ID NO: 832 - RNA, 19 nt, Artificial Sequence
  source: /note="Description of Artificial Sequence: Synthetic oligonucleotide"
gcuuauuacuagagcagac

SEQ ID NO: 833 - RNA, 19 nt, Artificial Sequence
  source: /note="Description of Artificial Sequence: Synthetic oligonucleotide"
acuagucguggaauggcac

SEQ ID NO: 834 - RNA, 19 nt, Artificial Sequence
  source: /note="Description of Artificial Sequence: Synthetic oligonucleotide"
acaauucgguugugaacau

SEQ ID NO: 835 - RNA, 19 nt, Artificial Sequence
  source: /note="Description of Artificial Sequence: Synthetic oligonucleotide"
gcaacugaacuagucgugg

SEQ ID NO: 836 - RNA, 19 nt, Artificial Sequence
  source: /note="Description of Artificial Sequence: Synthetic oligonucleotide"
agcaacugaacuagucgug

SEQ ID NO: 837 - RNA, 19 nt, Artificial Sequence
  source: /note="Description of Artificial Sequence: Synthetic oligonucleotide"
acgaacaagcaacugaacu

SEQ ID NO: 838 - RNA, 19 nt, Artificial Sequence
  source: /note="Description of Artificial Sequence: Synthetic oligonucleotide"
auggacguacggcgcuggg

SEQ ID NO: 839 - RNA, 19 nt, Artificial Sequence
  source: /note="Description of Artificial Sequence: Synthetic oligonucleotide"
uccuagagugaaguaacuc

SEQ ID NO: 840 - RNA, 19 nt, Artificial Sequence
  source: /note="Description of Artificial Sequence: Synthetic oligonucleotide"
ucgagucauugcauacugu

SEQ ID NO: 841 - RNA, 19 nt, Artificial Sequence
  source: /note="Description of Artificial Sequence: Synthetic oligonucleotide"
gagcucgagucauugcaua

SEQ ID NO: 842 - RNA, 19 nt, Artificial Sequence
  source: /note="Description of Artificial Sequence: Synthetic oligonucleotide"
aacgcuggacauuaguggg

SEQ ID NO: 843 - RNA, 19 nt, Artificial Sequence
  source: /note="Description of Artificial Sequence: Synthetic oligonucleotide"
ggaaagguuaugcaagguc

SEQ ID NO: 844 - RNA, 19 nt, Artificial Sequence
  source: /note="Description of Artificial Sequence: Synthetic oligonucleotide"
aaggcagucugucguaaua

SEQ ID NO: 845 - RNA, 19 nt, Artificial Sequence
  source: /note="Description of Artificial Sequence: Synthetic oligonucleotide"
uggugucggcuggucagau

SEQ ID NO: 846 - RNA, 19 nt, Artificial Sequence
  source: /note="Description of Artificial Sequence: Synthetic oligonucleotide"
cugaacuagucguggaaug

SEQ ID NO: 847 - RNA, 19 nt, Artificial Sequence
  source: /note="Description of Artificial Sequence: Synthetic oligonucleotide"
cacgcuggauuuucaaaac

SEQ ID NO: 848 - RNA, 19 nt, Artificial Sequence
  source: /note="Description of Artificial Sequence: Synthetic oligonucleotide"
ugaugguucagccaaacgc

SEQ ID NO: 849 - RNA, 19 nt, Artificial Sequence
  source: /note="Description of Artificial Sequence: Synthetic oligonucleotide"
agaacgcaugauagcgugu

SEQ ID NO: 850 - RNA, 19 nt, Artificial Sequence
  source: /note="Description of Artificial Sequence: Synthetic oligonucleotide"
ggagaguuguaauggcaua

SEQ ID NO: 851 - RNA, 19 nt, Artificial Sequence
  source: /note="Description of Artificial Sequence: Synthetic oligonucleotide"
ggcuuauuacuagagcaga

SEQ ID NO: 852 - RNA, 19 nt, Artificial Sequence
  source: /note="Description of Artificial Sequence: Synthetic oligonucleotide"
uucgguugugaacaucccg

SEQ ID NO: 853 - RNA, 19 nt, Artificial Sequence
  source: /note="Description of Artificial Sequence: Synthetic oligonucleotide"
caaaauccauuuguauugu

SEQ ID NO: 854 - RNA, 19 nt, Artificial Sequence
  source: /note="Description of Artificial Sequence: Synthetic oligonucleotide"
acucccaaaauccauuugu

SEQ ID NO: 855 - RNA, 19 nt, Artificial Sequence
  source: /note="Description of Artificial Sequence: Synthetic oligonucleotide"
cuucuugagucacucccaa

SEQ ID NO: 856 - RNA, 19 nt, Artificial Sequence
  source: /note="Description of Artificial Sequence: Synthetic oligonucleotide"
acuucuugagucacuccca

SEQ ID NO: 857 - RNA, 19 nt, Artificial Sequence
  source: /note="Description of Artificial Sequence: Synthetic oligonucleotide"
cuugugcauucuucacuuc

SEQ ID NO: 858 - RNA, 19 nt, Artificial Sequence
  source: /note="Description of Artificial Sequence: Synthetic oligonucleotide"
ucuugugcauucuucacuu

SEQ ID NO: 859 - RNA, 19 nt, Artificial Sequence
  source: /note="Description of Artificial Sequence: Synthetic oligonucleotide"
ggguuugauaaauuccauc

SEQ ID NO: 860 - RNA, 19 nt, Artificial Sequence
  source: /note="Description of Artificial Sequence: Synthetic oligonucleotide"
aggguuugauaaauuccau

SEQ ID NO: 861 - RNA, 19 nt, Artificial Sequence
  source: /note="Description of Artificial Sequence: Synthetic oligonucleotide"
cuaggguuugauaaauucc

SEQ ID NO: 862 - RNA, 19 nt, Artificial Sequence
  source: /note="Description of Artificial Sequence: Synthetic oligonucleotide"
gcuaggguuugauaaauuc

SEQ ID NO: 863 - RNA, 19 nt, Artificial Sequence
  source: /note="Description of Artificial Sequence: Synthetic oligonucleotide"
ggcuaggguuugauaaauu

SEQ ID NO: 864 - RNA, 19 nt, Artificial Sequence
  source: /note="Description of Artificial Sequence: Synthetic oligonucleotide"
aguaccauuacagauauuc

SEQ ID NO: 865 - RNA, 19 nt, Artificial Sequence
  source: /note="Description of Artificial Sequence: Synthetic oligonucleotide"
caguaccauuacagauauu

SEQ ID NO: 866 - RNA, 19 nt, Artificial Sequence
  source: /note="Description of Artificial Sequence: Synthetic oligonucleotide"
ucaguaccauuacagauau

SEQ ID NO: 867 - RNA, 19 nt, Artificial Sequence
  source: /note="Description of Artificial Sequence: Synthetic oligonucleotide"
cacuacgagagacuuaaaa

SEQ ID NO: 868 - RNA, 19 nt, Artificial Sequence
  source: /note="Description of Artificial Sequence: Synthetic oligonucleotide"
acacuacgagagacuuaaa

SEQ ID NO: 869 - RNA, 19 nt, Artificial Sequence
  source: /note="Description of Artificial Sequence: Synthetic oligonucleotide"
cuuaacacuacgagagacu

SEQ ID NO: 870 - RNA, 19 nt, Artificial Sequence
  source: /note="Description of Artificial Sequence: Synthetic oligonucleotide"
cuauaacuuaacacuacga

SEQ ID NO: 871 - RNA, 19 nt, Artificial Sequence
  source: /note="Description of Artificial Sequence: Synthetic oligonucleotide"
acuauaacuuaacacuacg

SEQ ID NO: 872 - RNA, 19 nt, Artificial Sequence
  source: /note="Description of Artificial Sequence: Synthetic oligonucleotide"
cacuauaacuuaacacuac

SEQ ID NO: 873 - RNA, 19 nt, Artificial Sequence
  source: /note="Description of Artificial Sequence: Synthetic oligonucleotide"
ucacuauaacuuaacacua

SEQ ID NO: 874 - RNA, 19 nt, Artificial Sequence
  source: /note="Description of Artificial Sequence: Synthetic oligonucleotide"
gcuguagcaguauucacua

SEQ ID NO: 875 - RNA, 19 nt, Artificial Sequence
  source: /note="Description of Artificial Sequence: Synthetic oligonucleotide"
gugauuaugaauuaguguu

SEQ ID NO: 876 - RNA, 19 nt, Artificial Sequence
  source: /note="Description of Artificial Sequence: Synthetic oligonucleotide"
agugauuaugaauuagugu

SEQ ID NO: 877 - RNA, 19 nt, Artificial Sequence
  source: /note="Description of Artificial Sequence: Synthetic oligonucleotide"
uuuauucagauuacaauua

SEQ ID NO: 878 - RNA, 19 nt, Artificial Sequence
  source: /note="Description of Artificial Sequence: Synthetic oligonucleotide"
acuuuauucagauuacaau

SEQ ID NO: 879 - RNA, 19 nt, Artificial Sequence
  source: /note="Description of Artificial Sequence: Synthetic oligonucleotide"
cacuuuauucagauuacaa

SEQ ID NO: 880 - RNA, 19 nt, Artificial Sequence
  source: /note="Description of Artificial Sequence: Synthetic oligonucleotide"
acacuuuauucagauuaca

SEQ ID NO: 881 - RNA, 19 nt, Artificial Sequence
  source: /note="Description of Artificial Sequence: Synthetic oligonucleotide"
ggaccauuuucuauuuguc

SEQ ID NO: 882 - RNA, 19 nt, Artificial Sequence
  source: /note="Description of Artificial Sequence: Synthetic oligonucleotide"
uggaccauuuucuauuugu

SEQ ID NO: 883 - RNA, 19 nt, Artificial Sequence
  source: /note="Description of Artificial Sequence: Synthetic oligonucleotide"
cuaauuggaccauuuucua

SEQ ID NO: 884 - RNA, 19 nt, Artificial Sequence
  source: /note="Description of Artificial Sequence: Synthetic oligonucleotide"
acuaauuggaccauuuucu

SEQ ID NO: 885 - RNA, 19 nt, Artificial Sequence
  source: /note="Description of Artificial Sequence: Synthetic oligonucleotide"
cccauacauaucccaaaua

SEQ ID NO: 886 - RNA, 19 nt, Artificial Sequence
  source: /note="Description of Artificial Sequence: Synthetic oligonucleotide"
acccauacauaucccaaau

SEQ ID NO: 887 - RNA, 19 nt, Artificial Sequence
  source: /note="Description of Artificial Sequence: Synthetic oligonucleotide"
cuacccauacauaucccaa

SEQ ID NO: 888 - RNA, 19 nt, Artificial Sequence
  source: /note="Description of Artificial Sequence: Synthetic oligonucleotide"
acccuacccauacauaucc

SEQ ID NO: 889 - RNA, 19 nt, Artificial Sequence
  source: /note="Description of Artificial Sequence: Synthetic oligonucleotide"
guuccaaauaacaccucuu

SEQ ID NO: 890 - RNA, 19 nt, Artificial Sequence
  source: /note="Description of Artificial Sequence: Synthetic oligonucleotide"
gguuccaaauaacaccucu

SEQ ID NO: 891 - RNA, 19 nt, Artificial Sequence
  source: /note="Description of Artificial Sequence: Synthetic oligonucleotide"
agguuccaaauaacaccuc

SEQ ID NO: 892 - RNA, 19 nt, Artificial Sequence
  source: /note="Description of Artificial Sequence: Synthetic oligonucleotide"
uguccaaaacaagguucca

SEQ ID NO: 893 - RNA, 19 nt, Artificial Sequence
  source: /note="Description of Artificial Sequence: Synthetic oligonucleotide"
cuguccaaaacaagguucc

SEQ ID NO: 894 - RNA, 19 nt, Artificial Sequence
  source: /note="Description of Artificial Sequence: Synthetic oligonucleotide"
acuguccaaaacaagguuc

SEQ ID NO: 895 - RNA, 19 nt, Artificial Sequence
  source: /note="Description of Artificial Sequence: Synthetic oligonucleotide"
cugguaaacuguccaaaac

SEQ ID NO: 896 - RNA, 19 nt, Artificial Sequence
  source: /note="Description of Artificial Sequence: Synthetic oligonucleotide"
acugguaaacuguccaaaa

SEQ ID NO: 897 - RNA, 19 nt, Artificial Sequence
  source: /note="Description of Artificial Sequence: Synthetic oligonucleotide"
caacugguaaacuguccaa

SEQ ID NO: 898 - RNA, 19 nt, Artificial Sequence
  source: /note="Description of Artificial Sequence: Synthetic oligonucleotide"
cacagcagguuacaacaac

SEQ ID NO: 899 - RNA, 19 nt, Artificial Sequence
  source: /note="Description of Artificial Sequence: Synthetic oligonucleotide"
ucacagcagguuacaacaa

SEQ ID NO: 900 - RNA, 19 nt, Artificial Sequence
  source: /note="Description of Artificial Sequence: Synthetic oligonucleotide"
guaucacagcagguuacaa

SEQ ID NO: 901 - RNA, 19 nt, Artificial Sequence
  source: /note="Description of Artificial Sequence: Synthetic oligonucleotide"
gcauuuucucuugaagcau

SEQ ID NO: 902 - RNA, 19 nt, Artificial Sequence
  source: /note="Description of Artificial Sequence: Synthetic oligonucleotide"
uucuugugcauucuucacu

SEQ ID NO: 903 - RNA, 19 nt, Artificial Sequence
  source: /note="Description of Artificial Sequence: Synthetic oligonucleotide"
uuccaucuugugauccauu

SEQ ID NO: 904 - RNA, 19 nt, Artificial Sequence
  source: /note="Description of Artificial Sequence: Synthetic oligonucleotide"
auuccaucuugugauccau

SEQ ID NO: 905 - RNA, 19 nt, Artificial Sequence
  source: /note="Description of Artificial Sequence: Synthetic oligonucleotide"
aauuccaucuugugaucca

SEQ ID NO: 906 - RNA, 19 nt, Artificial Sequence
  source: /note="Description of Artificial Sequence: Synthetic oligonucleotide"
aaauuccaucuugugaucc

SEQ ID NO: 907 - RNA, 19 nt, Artificial Sequence
  source: /note="Description of Artificial Sequence: Synthetic oligonucleotide"
uaaauuccaucuugugauc

SEQ ID NO: 908 - RNA, 19 nt, Artificial Sequence
  source: /note="Description of Artificial Sequence: Synthetic oligonucleotide"
auaaauuccaucuugugau

SEQ ID NO: 909 - RNA, 19 nt, Artificial Sequence
  source: /note="Description of Artificial Sequence: Synthetic oligonucleotide"
uaggguuugauaaauucca

SEQ ID NO: 910 - RNA, 19 nt, Artificial Sequence
  source: /note="Description of Artificial Sequence: Synthetic oligonucleotide"
uaacaagcaaggcuagggu

SEQ ID NO: 911 - RNA, 19 nt, Artificial Sequence
  source: /note="Description of Artificial Sequence: Synthetic oligonucleotide"
uuaacaagcaaggcuaggg

SEQ ID NO: 912 - RNA, 19 nt, Artificial Sequence
  source: /note="Description of Artificial Sequence: Synthetic oligonucleotide"
uuuaacaagcaaggcuagg

SEQ ID NO: 913 - RNA, 19 nt, Artificial Sequence
  source: /note="Description of Artificial Sequence: Synthetic oligonucleotide"
auuuaacaagcaaggcuag

SEQ ID NO: 914 - RNA, 19 nt, Artificial Sequence
  source: /note="Description of Artificial Sequence: Synthetic oligonucleotide"
aauuuaacaagcaaggcua

SEQ ID NO: 915 - RNA, 19 nt, Artificial Sequence
  source: /note="Description of Artificial Sequence: Synthetic oligonucleotide"
aaauuuaacaagcaaggcu

SEQ ID NO: 916 - RNA, 19 nt, Artificial Sequence
  source: /note="Description of Artificial Sequence: Synthetic oligonucleotide"
aacacuacgagagacuuaa

SEQ ID NO: 917 - RNA, 19 nt, Artificial Sequence
  source: /note="Description of Artificial Sequence: Synthetic oligonucleotide"
uaacacuacgagagacuua

SEQ ID NO: 918 - RNA, 19 nt, Artificial Sequence
  source: /note="Description of Artificial Sequence: Synthetic oligonucleotide"
uuaacacuacgagagacuu

SEQ ID NO: 919 - RNA, 19 nt, Artificial Sequence
  source: /note="Description of Artificial Sequence: Synthetic oligonucleotide"
uauaacuuaacacuacgag

SEQ ID NO: 920 - RNA, 19 nt, Artificial Sequence
  source: /note="Description of Artificial Sequence: Synthetic oligonucleotide"
uucacuauaacuuaacacu

SEQ ID NO: 921 - RNA, 19 nt, Artificial Sequence
  source: /note="Description of Artificial Sequence: Synthetic oligonucleotide"
auucacuauaacuuaacac

SEQ ID NO: 922 - RNA, 19 nt, Artificial Sequence
  source: /note="Description of Artificial Sequence: Synthetic oligonucleotide"
aaauuagaaauugcuguag

SEQ ID NO: 923 - RNA, 19 nt, Artificial Sequence
  source: /note="Description of Artificial Sequence: Synthetic oligonucleotide"
uuggaccauuuucuauuug

SEQ ID NO: 924 - RNA, 19 nt, Artificial Sequence
  source: /note="Description of Artificial Sequence: Synthetic oligonucleotide"
uaauuggaccauuuucuau

SEQ ID NO: 925 - RNA, 19 nt, Artificial Sequence
  source: /note="Description of Artificial Sequence: Synthetic oligonucleotide"
uacccauacauaucccaaa

SEQ ID NO: 926 - RNA, 19 nt, Artificial Sequence
  source: /note="Description of Artificial Sequence: Synthetic oligonucleotide"
uacccuacccauacauauc

SEQ ID NO: 927 - RNA, 19 nt, Artificial Sequence
  source: /note="Description of Artificial Sequence: Synthetic oligonucleotide"
uacugauuuacccuaccca

SEQ ID NO: 928 - RNA, 19 nt, Artificial Sequence
  source: /note="Description of Artificial Sequence: Synthetic oligonucleotide"
uuccaaauaacaccucuua

SEQ ID NO: 929 - RNA, 19 nt, Artificial Sequence
  source: /note="Description of Artificial Sequence: Synthetic oligonucleotide"
aacuuugggauaaaaggca

SEQ ID NO: 930 - RNA, 19 nt, Artificial Sequence
  source: /note="Description of Artificial Sequence: Synthetic oligonucleotide"
aucacagcagguuacaaca

SEQ ID NO: 931 - RNA, 19 nt, Artificial Sequence
  source: /note="Description of Artificial Sequence: Synthetic oligonucleotide"
uaucacagcagguuacaac

SEQ ID NO: 932 - RNA, 19 nt, Artificial Sequence
  source: /note="Description of Artificial Sequence: Synthetic oligonucleotide"
auaaccgcauuuucucuug

SEQ ID NO: 933 - RNA, 19 nt, Artificial Sequence
  source: /note="Description of Artificial Sequence: Synthetic oligonucleotide"
uauaaccgcauuuucucuu

SEQ ID NO: 934 - RNA, 19 nt, Artificial Sequence
  source: /note="Description of Artificial Sequence: Synthetic oligonucleotide"
auacccucaggggaacagg

SEQ ID NO: 935 - RNA, 19 nt, Artificial Sequence
  source: /note="Description of Artificial Sequence: Synthetic oligonucleotide"
aauacccucaggggaacag

SEQ ID NO: 936 - RNA, 19 nt, Artificial Sequence
  source: /note="Description of Artificial Sequence: Synthetic oligonucleotide"
uacuucaaauacccucagg

SEQ ID NO: 937 - RNA, 19 nt, Artificial Sequence
  source: /note="Description of Artificial Sequence: Synthetic oligonucleotide"
auacuucaaauacccucag

SEQ ID NO: 938 - RNA, 19 nt, Artificial Sequence
  source: /note="Description of Artificial Sequence: Synthetic oligonucleotide"
uauacuucaaauacccuca

SEQ ID NO: 939 - RNA, 19 nt, Artificial Sequence
  source: /note="Description of Artificial Sequence: Synthetic oligonucleotide"
augguauacuucaaauacc

SEQ ID NO: 940 - RNA, 19 nt, Artificial Sequence
  source: /note="Description of Artificial Sequence: Synthetic oligonucleotide"
uaugguauacuucaaauac

SEQ ID NO: 941 - RNA, 19 nt, Artificial Sequence
  source: /note="Description of Artificial Sequence: Synthetic oligonucleotide"
uuguaugguauacuucaaa

SEQ ID NO: 942 - RNA, 19 nt, Artificial Sequence
  source: /note="Description of Artificial Sequence: Synthetic oligonucleotide"
aacaguuguaugguauacu

SEQ ID NO: 943 - RNA, 19 nt, Artificial Sequence
  source: /note="Description of Artificial Sequence: Synthetic oligonucleotide"
aaacaguuguaugguauac

SEQ ID NO: 944 - RNA, 19 nt, Artificial Sequence
  source: /note="Description of Artificial Sequence: Synthetic oligonucleotide"
aaaacaguuguaugguaua

SEQ ID NO: 945 - RNA, 19 nt, Artificial Sequence
  source: /note="Description of Artificial Sequence: Synthetic oligonucleotide"
uucaaaacaguuguauggu

SEQ ID NO: 946 - RNA, 19 nt, Artificial Sequence
  source: /note="Description of Artificial Sequence: Synthetic oligonucleotide"
uuucaaaacaguuguaugg

SEQ ID NO: 947 - RNA, 19 nt, Artificial Sequence
  source: /note="Description of Artificial Sequence: Synthetic oligonucleotide"
uuguccacgcuggauuuuc

SEQ ID NO: 948 - RNA, 19 nt, Artificial Sequence
  source: /note="Description of Artificial Sequence: Synthetic oligonucleotide"
auuguccacgcuggauuuu

SEQ ID NO: 949 - RNA, 19 nt, Artificial Sequence
  source: /note="Description of Artificial Sequence: Synthetic oligonucleotide"
uagccauuguccacgcugg

SEQ ID NO: 950 - RNA, 19 nt, Artificial Sequence
  source: /note="Description of Artificial Sequence: Synthetic oligonucleotide"
uugaguagccauuguccac

SEQ ID NO: 951 - RNA, 19 nt, Artificial Sequence
  source: /note="Description of Artificial Sequence: Synthetic oligonucleotide"
aucagcuugaguagccauu

SEQ ID NO: 952 - RNA, 19 nt, Artificial Sequence
  source: /note="Description of Artificial Sequence: Synthetic oligonucleotide"
aaucagcuugaguagccau

SEQ ID NO: 953 - RNA, 19 nt, Artificial Sequence
  source: /note="Description of Artificial Sequence: Synthetic oligonucleotide"
aaaucagcuugaguagcca

SEQ ID NO: 954 - RNA, 19 nt, Artificial Sequence
  source: /note="Description of Artificial Sequence: Synthetic oligonucleotide"
aucaaaucagcuugaguag

SEQ ID NO: 955 - RNA, 19 nt, Artificial Sequence
  source: /note="Description of Artificial Sequence: Synthetic oligonucleotide"
auguccaacuccaucaaau

SEQ ID NO: 956 - RNA, 19 nt, Artificial Sequence
  source: /note="Description of Artificial Sequence: Synthetic oligonucleotide"
auggccauguccaacucca

SEQ ID NO: 957 - RNA, 19 nt, Artificial Sequence
  source: /note="Description of Artificial Sequence: Synthetic oligonucleotide"
uuccauggccauguccaac

SEQ ID NO: 958 - RNA, 19 nt, Artificial Sequence
  source: /note="Description of Artificial Sequence: Synthetic oligonucleotide"
uucugucugguuccauggc

SEQ ID NO: 959 - RNA, 19 nt, Artificial Sequence
  source: /note="Description of Artificial Sequence: Synthetic oligonucleotide"
uuuucugucugguuccaug

SEQ ID NO: 960 - RNA, 19 nt, Artificial Sequence
  source: /note="Description of Artificial Sequence: Synthetic oligonucleotide"
uuccuccgucuccgccucc

SEQ ID NO: 961 - RNA, 19 nt, Artificial Sequence
  source: /note="Description of Artificial Sequence: Synthetic oligonucleotide"
aacagccgcuuuucugucu

SEQ ID NO: 962 - RNA, 19 nt, Artificial Sequence
  source: /note="Description of Artificial Sequence: Synthetic oligonucleotide"
uaacagccgcuuuucuguc

SEQ ID NO: 963 - RNA, 19 nt, Artificial Sequence
  source: /note="Description of Artificial Sequence: Synthetic oligonucleotide"
uugcugccagugacuaaca

SEQ ID NO: 964 - RNA, 19 nt, Artificial Sequence
  source: /note="Description of Artificial Sequence: Synthetic oligonucleotide"
aagacuguugcugccagug

SEQ ID NO: 965 - RNA, 19 nt, Artificial Sequence
  source: /note="Description of Artificial Sequence: Synthetic oligonucleotide"
uaagacuguugcugccagu

SEQ ID NO: 966 - RNA, 19 nt, Artificial Sequence
  source: /note="Description of Artificial Sequence: Synthetic oligonucleotide"
uuccagaguccagguaaga

SEQ ID NO: 967 - RNA, 19 nt, Artificial Sequence
  source: /note="Description of Artificial Sequence: Synthetic oligonucleotide"
auuccagaguccagguaag

SEQ ID NO: 968 - RNA, 19 nt, Artificial Sequence
  source: /note="Description of Artificial Sequence: Synthetic oligonucleotide"
auggauuccagaguccagg

SEQ ID NO: 969 - RNA, 19 nt, Artificial Sequence
  source: /note="Description of Artificial Sequence: Synthetic oligonucleotide"
uugggguccaccacuagcc

SEQ ID NO: 970 - RNA, 19 nt, Artificial Sequence
  source: /note="Description of Artificial Sequence: Synthetic oligonucleotide"
aaggagcugugguaguggc

SEQ ID NO: 971 - RNA, 19 nt, Artificial Sequence
  source: /note="Description of Artificial Sequence: Synthetic oligonucleotide"
uuuaccacucagagaagga

SEQ ID NO: 972 - RNA, 19 nt, Artificial Sequence
  source: /note="Description of Artificial Sequence: Synthetic oligonucleotide"
uugccuuuaccacucagag

SEQ ID NO: 973 - RNA, 19 nt, Artificial Sequence
  source: /note="Description of Artificial Sequence: Synthetic oligonucleotide"
uuccucaggauugccuuua

SEQ ID NO: 974 - RNA, 19 nt, Artificial Sequence
  source: /note="Description of Artificial Sequence: Synthetic oligonucleotide"
auccucuuccucaggauug

SEQ ID NO: 975 - RNA, 19 nt, Artificial Sequence
  source: /note="Description of Artificial Sequence: Synthetic oligonucleotide"
auccacauccucuuccuca

SEQ ID NO: 976 - RNA, 19 nt, Artificial Sequence
  source: /note="Description of Artificial Sequence: Synthetic oligonucleotide"
uacaggacuugggagguau

SEQ ID NO: 977 - RNA, 19 nt, Artificial Sequence
  source: /note="Description of Artificial Sequence: Synthetic oligonucleotide"
auacaggacuugggaggua

SEQ ID NO: 978 - RNA, 19 nt, Artificial Sequence
  source: /note="Description of Artificial Sequence: Synthetic oligonucleotide"
uucccacucauacaggacu

SEQ ID NO: 979 - RNA, 19 nt, Artificial Sequence
  source: /note="Description of Artificial Sequence: Synthetic oligonucleotide"
aucccuguucccacucaua

SEQ ID NO: 980 - RNA, 19 nt, Artificial Sequence
  source: /note="Description of Artificial Sequence: Synthetic oligonucleotide"
uuauauuuacuaaagcuug

SEQ ID NO: 981 - RNA, 19 nt, Artificial Sequence
  source: /note="Description of Artificial Sequence: Synthetic oligonucleotide"
auuauauuuacuaaagcuu

SEQ ID NO: 982 - RNA, 19 nt, Artificial Sequence
  source: /note="Description of Artificial Sequence: Synthetic oligonucleotide"
aaaucccuguucccacuca

SEQ ID NO: 983 - RNA, 19 nt, Artificial Sequence
  source: /note="Description of Artificial Sequence: Synthetic oligonucleotide"
aaaaucccuguucccacuc

SEQ ID NO: 984 - RNA, 19 nt, Artificial Sequence
  source: /note="Description of Artificial Sequence: Synthetic oligonucleotide"
aaggacugagaaaaucccu

SEQ ID NO: 985 - RNA, 19 nt, Artificial Sequence
  source: /note="Description of Artificial Sequence: Synthetic oligonucleotide"
uugagugaaggacugagaa

SEQ ID NO: 986 - RNA, 19 nt, Artificial Sequence
  source: /note="Description of Artificial Sequence: Synthetic oligonucleotide"
uucuugagugaaggacuga

SEQ ID NO: 987 - RNA, 19 nt, Artificial Sequence
  source: /note="Description of Artificial Sequence: Synthetic oligonucleotide"
uacuuguucuugagugaag

SEQ ID NO: 988 - RNA, 19 nt, Artificial Sequence
  source: /note="Description of Artificial Sequence: Synthetic oligonucleotide"
aucagcuacuuguucuuga

SEQ ID NO: 989 - RNA, 19 nt, Artificial Sequence
  source: /note="Description of Artificial Sequence: Synthetic oligonucleotide"
uacuguccaucaauaucag

SEQ ID NO: 990 - RNA, 19 nt, Artificial Sequence
  source: /note="Description of Artificial Sequence: Synthetic oligonucleotide"
uugcauacuguccaucaau

SEQ ID NO: 991 - RNA, 19 nt, Artificial Sequence
  source: /note="Description of Artificial Sequence: Synthetic oligonucleotide"
uacccucugagcucgaguc

SEQ ID NO: 992 - RNA, 19 nt, Artificial Sequence
  source: /note="Description of Artificial Sequence: Synthetic oligonucleotide"
uagcagcucguacccucug

SEQ ID NO: 993 - RNA, 19 nt, Artificial Sequence
  source: /note="Description of Artificial Sequence: Synthetic oligonucleotide"
auagcagcucguacccucu

SEQ ID NO: 994 - RNA, 19 nt, Artificial Sequence
  source: /note="Description of Artificial Sequence: Synthetic oligonucleotide"
aacauagcagcucguaccc

SEQ ID NO: 995 - RNA, 19 nt, Artificial Sequence
  source: /note="Description of Artificial Sequence: Synthetic oligonucleotide"
aaugucucagggaacauag

SEQ ID NO: 996 - RNA, 19 nt, Artificial Sequence
  source: /note="Description of Artificial Sequence: Synthetic oligonucleotide"
uaaugucucagggaacaua

SEQ ID NO: 997 - RNA, 19 nt, Artificial Sequence
  source: /note="Description of Artificial Sequence: Synthetic oligonucleotide"
aucuaaugucucagggaac

SEQ ID NO: 998 - RNA, 19 nt, Artificial Sequence
  source: /note="Description of Artificial Sequence: Synthetic oligonucleotide"
aucugcaugcccucaucua

SEQ ID NO: 999 - RNA, 19 nt, Artificial Sequence
  source: /note="Description of Artificial Sequence: Synthetic oligonucleotide"
augggaucugcaugcccuc

SEQ ID NO: 1000 - RNA, 19 nt, Artificial Sequence
  source: /note="Description of Artificial Sequence: Synthetic oligonucleotide"
uagaugggaucugcaugcc

SEQ ID NO: 1001 - RNA, 19 nt, Artificial Sequence
  source: /note="Description of Artificial Sequence: Synthetic oligonucleotide"
aacuguguagaugggaucu

SEQ ID NO: 1002 - RNA, 19 nt, Artificial Sequence
  source: /note="Description of Artificial Sequence: Synthetic oligonucleotide"
aucaaacuguguagauggg

SEQ ID NO: 1003 - RNA, 19 nt, Artificial Sequence
  source: /note="Description of Artificial Sequence: Synthetic oligonucleotide"
augagcagcaucaaacugu

SEQ ID NO: 1004 - RNA, 19 nt, Artificial Sequence
  source: /note="Description of Artificial Sequence: Synthetic oligonucleotide"
uagugggaugagcagcauc

SEQ ID NO: 1005 - RNA, 19 nt, Artificial Sequence
  source: /note="Description of Artificial Sequence: Synthetic oligonucleotide"
uuagugggaugagcagcau

SEQ ID NO: 1006 - RNA, 19 nt, Artificial Sequence
  source: /note="Description of Artificial Sequence: Synthetic oligonucleotide"
auuagugggaugagcagca

SEQ ID NO: 1007 - RNA, 19 nt, Artificial Sequence
  source: /note="Description of Artificial Sequence: Synthetic oligonucleotide"
aacgcuggacauuaguggg

SEQ ID NO: 1008 - RNA, 19 nt, Artificial Sequence
  source: /note="Description of Artificial Sequence: Synthetic oligonucleotide"
augguucagccaaacgcug

SEQ ID NO: 1009 - RNA, 19 nt, Artificial Sequence
  source: /note="Description of Artificial Sequence: Synthetic oligonucleotide"
aucugugaugguucagcca

SEQ ID NO: 1010 - RNA, 19 nt, Artificial Sequence
  source: /note="Description of Artificial Sequence: Synthetic oligonucleotide"
uucagcaucugugaugguu

SEQ ID NO: 1011 - RNA, 19 nt, Artificial Sequence
  source: /note="Description of Artificial Sequence: Synthetic oligonucleotide"
uuucagcaucugugauggu

SEQ ID NO: 1012 - RNA, 19 nt, Artificial Sequence
  source: /note="Description of Artificial Sequence: Synthetic oligonucleotide"
auguuucagcaucugugau

SEQ ID NO: 1013 - RNA, 19 nt, Artificial Sequence
  source: /note="Description of Artificial Sequence: Synthetic oligonucleotide"
aacugcauguuucagcauc

SEQ ID NO: 1014 - RNA, 19 nt, Artificial Sequence
  source: /note="Description of Artificial Sequence: Synthetic oligonucleotide"
uuacaacugcauguuucag

SEQ ID NO: 1015 - RNA, 19 nt, Artificial Sequence
  source: /note="Description of Artificial Sequence: Synthetic oligonucleotide"
aaguuuacaacugcauguu

SEQ ID NO: 1016 - RNA, 19 nt, Artificial Sequence
  source: /note="Description of Artificial Sequence: Synthetic oligonucleotide"
aucaaguuuacaacugcau

SEQ ID NO: 1017 - RNA, 19 nt, Artificial Sequence
  source: /note="Description of Artificial Sequence: Synthetic oligonucleotide"
aaucaaguuuacaacugca

SEQ ID NO: 1018 - RNA, 19 nt, Artificial Sequence
  source: /note="Description of Artificial Sequence: Synthetic oligonucleotide"
uuaaucaaguuuacaacug

SEQ ID NO: 1019 - RNA, 19 nt, Artificial Sequence
  source: /note="Description of Artificial Sequence: Synthetic oligonucleotide"
aucuugauaguuaaucaag

SEQ ID NO: 1020 - RNA, 19 nt, Artificial Sequence
  source: /note="Description of Artificial Sequence: Synthetic oligonucleotide"
aucaucuugauaguuaauc

SEQ ID NO: 1021 - RNA, 19 nt, Artificial Sequence
  source: /note="Description of Artificial Sequence: Synthetic oligonucleotide"
uucugcaucaucuugauag

SEQ ID NO: 1022 - RNA, 19 nt, Artificial Sequence
  source: /note="Description of Artificial Sequence: Synthetic oligonucleotide"
uugcacguguggcaaguuc

SEQ ID NO: 1023 - RNA, 19 nt, Artificial Sequence
  source: /note="Description of Artificial Sequence: Synthetic oligonucleotide"
auugcacguguggcaaguu

SEQ ID NO: 1024 - RNA, 19 nt, Artificial Sequence
  source: /note="Description of Artificial Sequence: Synthetic oligonucleotide"
uucagggauugcacgugug

SEQ ID NO: 1025 - RNA, 19 nt, Artificial Sequence
  source: /note="Description of Artificial Sequence: Synthetic oligonucleotide"
uugucaguucagggauugc

SEQ ID NO: 1026 - RNA, 19 nt, Artificial Sequence
  source: /note="Description of Artificial Sequence: Synthetic oligonucleotide"
uuugucaguucagggauug

SEQ ID NO: 1027 - RNA, 19 nt, Artificial Sequence
  source: /note="Description of Artificial Sequence: Synthetic oligonucleotide"
uuuugucaguucagggauu

SEQ ID NO: 1028 - RNA, 19 nt, Artificial Sequence
  source: /note="Description of Artificial Sequence: Synthetic oligonucleotide"
uagcaguuuugucaguuca

SEQ ID NO: 1029 - RNA, 19 nt, Artificial Sequence
  source: /note="Description of Artificial Sequence: Synthetic oligonucleotide"
uuagcaguuuugucaguuc

SEQ ID NO: 1030 - RNA, 19 nt, Artificial Sequence
  source: /note="Description of Artificial Sequence: Synthetic oligonucleotide"
uuuagcaguuuugucaguu

SEQ ID NO: 1031 - RNA, 19 nt, Artificial Sequence
  source: /note="Description of Artificial Sequence: Synthetic oligonucleotide"
auuuagcaguuuugucagu

SEQ ID NO: 1032 - RNA, 19 nt, Artificial Sequence
  source: /note="Description of Artificial Sequence: Synthetic oligonucleotide"
uaaccaccaccugguccuc

SEQ ID NO: 1033 - RNA, 19 nt, Artificial Sequence
  source: /note="Description of Artificial Sequence: Synthetic oligonucleotide"
uuaaccaccaccugguccu

SEQ ID NO: 1034 - RNA, 19 nt, Artificial Sequence
  source: /note="Description of Artificial Sequence: Synthetic oligonucleotide"
auuaaccaccaccuggucc

SEQ ID NO: 1035 - RNA, 19 nt, Artificial Sequence
  source: /note="Description of Artificial Sequence: Synthetic oligonucleotide"
uauuaaccaccaccugguc

SEQ ID NO: 1036 - RNA, 19 nt, Artificial Sequence
  source: /note="Description of Artificial Sequence: Synthetic oligonucleotide"
uuauaauuauugcaaguga

SEQ ID NO: 1037 - RNA, 19 nt, Artificial Sequence
  source: /note="Description of Artificial Sequence: Synthetic oligonucleotide"
uucuuauaauuauugcaag

SEQ ID NO: 1038 - RNA, 19 nt, Artificial Sequence
  source: /note="Description of Artificial Sequence: Synthetic oligonucleotide"
uuauuaaccaccaccuggu

SEQ ID NO: 1039 - RNA, 19 nt, Artificial Sequence
  source: /note="Description of Artificial Sequence: Synthetic oligonucleotide"
auggaccauaacugcagcc

SEQ ID NO: 1040 - RNA, 19 nt, Artificial Sequence
  source: /note="Description of Artificial Sequence: Synthetic oligonucleotide"
aaagcugauggaccauaac

SEQ ID NO: 1041 - RNA, 19 nt, Artificial Sequence
  source: /note="Description of Artificial Sequence: Synthetic oligonucleotide"
uagaaagcugauggaccau

SEQ ID NO: 1042 - RNA, 19 nt, Artificial Sequence
  source: /note="Description of Artificial Sequence: Synthetic oligonucleotide"
uuagaaagcugauggacca

SEQ ID NO: 1043 - RNA, 19 nt, Artificial Sequence
  source: /note="Description of Artificial Sequence: Synthetic oligonucleotide"
uucccugucaccagcccga

SEQ ID NO: 1044 - RNA, 19 nt, Artificial Sequence
  source: /note="Description of Artificial Sequence: Synthetic oligonucleotide"
uuuagaaagcugauggacc

SEQ ID NO: 1045 - RNA, 19 nt, Artificial Sequence
  source: /note="Description of Artificial Sequence: Synthetic oligonucleotide"
uuuuagaaagcugauggac

SEQ ID NO: 1046 - RNA, 19 nt, Artificial Sequence
  source: /note="Description of Artificial Sequence: Synthetic oligonucleotide"
uagcgugucuggaagcuuc

SEQ ID NO: 1047 - RNA, 19 nt, Artificial Sequence
  source: /note="Description of Artificial Sequence: Synthetic oligonucleotide"
auagcgugucuggaagcuu

SEQ ID NO: 1048 - RNA, 19 nt, Artificial Sequence
  source: /note="Description of Artificial Sequence: Synthetic oligonucleotide"
augauagcgugucuggaag

SEQ ID NO: 1049 - RNA, 19 nt, Artificial Sequence
  source: /note="Description of Artificial Sequence: Synthetic oligonucleotide"
aacgcaugauagcgugucu

SEQ ID NO: 1050 - RNA, 19 nt, Artificial Sequence
  source: /note="Description of Artificial Sequence: Synthetic oligonucleotide"
aucugaggagaacgcauga

SEQ ID NO: 1051 - RNA, 19 nt, Artificial Sequence
  source: /note="Description of Artificial Sequence: Synthetic oligonucleotide"
uagcagacaccaucugagg

SEQ ID NO: 1052 - RNA, 19 nt, Artificial Sequence
  source: /note="Description of Artificial Sequence: Synthetic oligonucleotide"
auagcagacaccaucugag

SEQ ID NO: 1053 - RNA, 19 nt, Artificial Sequence
  source: /note="Description of Artificial Sequence: Synthetic oligonucleotide"
uacguacaauagcagacac

SEQ ID NO: 1054 - RNA, 19 nt, Artificial Sequence
  source: /note="Description of Artificial Sequence: Synthetic oligonucleotide"
augguacguacaauagcag

SEQ ID NO: 1055 - RNA, 19 nt, Artificial Sequence
  source: /note="Description of Artificial Sequence: Synthetic oligonucleotide"
uucugcaugguacguacaa

SEQ ID NO: 1056 - RNA, 19 nt, Artificial Sequence
  source: /note="Description of Artificial Sequence: Synthetic oligonucleotide"
auucugcaugguacguaca

SEQ ID NO: 1057 - RNA, 19 nt, Artificial Sequence
  source: /note="Description of Artificial Sequence: Synthetic oligonucleotide"
uuguauucugcaugguacg

SEQ ID NO: 1058 - RNA, 19 nt, Artificial Sequence
  source: /note="Description of Artificial Sequence: Synthetic oligonucleotide"
aucauuuguauucugcaug

SEQ ID NO: 1059 - RNA, 19 nt, Artificial Sequence
  source: /note="Description of Artificial Sequence: Synthetic oligonucleotide"
uacaucauuuguauucugc

SEQ ID NO: 1060 - RNA, 19 nt, Artificial Sequence
  source: /note="Description of Artificial Sequence: Synthetic oligonucleotide"
uucuacaucauuuguauuc

SEQ ID NO: 1061 - RNA, 19 nt, Artificial Sequence
  source: /note="Description of Artificial Sequence: Synthetic oligonucleotide"
aacgagcuguuucuacauc

SEQ ID NO: 1062 - RNA, 19 nt, Artificial Sequence
  source: /note="Description of Artificial Sequence: Synthetic oligonucleotide"
aaggucccagcgguacaac

SEQ ID NO: 1063 - RNA, 19 nt, Artificial Sequence
  source: /note="Description of Artificial Sequence: Synthetic oligonucleotide"
augcaaggucccagcggua

SEQ ID NO: 1064 - RNA, 19 nt, Artificial Sequence
  source: /note="Description of Artificial Sequence: Synthetic oligonucleotide"
uuaugcaaggucccagcgg

SEQ ID NO: 1065 - RNA, 19 nt, Artificial Sequence
  source: /note="Description of Artificial Sequence: Synthetic oligonucleotide"
aagguuaugcaagguccca

SEQ ID NO: 1066 - RNA, 19 nt, Artificial Sequence
  source: /note="Description of Artificial Sequence: Synthetic oligonucleotide"
aaagguuaugcaagguccc

SEQ ID NO: 1067 - RNA, 19 nt, Artificial Sequence
  source: /note="Description of Artificial Sequence: Synthetic oligonucleotide"
augggaaagguuaugcaag

SEQ ID NO: 1068 - RNA, 19 nt, Artificial Sequence
  source: /note="Description of Artificial Sequence: Synthetic oligonucleotide"
augccuccagacuuaaaga

SEQ ID NO: 1069 - RNA, 19 nt, Artificial Sequence
  source: /note="Description of Artificial Sequence: Synthetic oligonucleotide"
uucaccagggcaggaaugc

SEQ ID NO: 1070 - RNA, 19 nt, Artificial Sequence
  source: /note="Description of Artificial Sequence: Synthetic oligonucleotide"
uuucaccagggcaggaaug

SEQ ID NO: 1071 - RNA, 19 nt, Artificial Sequence
  source: /note="Description of Artificial Sequence: Synthetic oligonucleotide"
uuuucaccagggcaggaau

SEQ ID NO: 1072 - RNA, 19 nt, Artificial Sequence
  source: /note="Description of Artificial Sequence: Synthetic oligonucleotide"
auuuucaccagggcaggaa

SEQ ID NO: 1073 - RNA, 19 nt, Artificial Sequence
  source: /note="Description of Artificial Sequence: Synthetic oligonucleotide"
aagcauuuucaccagggca

SEQ ID NO: 1074 - RNA, 19 nt, Artificial Sequence
  source: /note="Description of Artificial Sequence: Synthetic oligonucleotide"
aaccaagcauuuucaccag

SEQ ID NO: 1075 - RNA, 19 nt, Artificial Sequence
  source: /note="Description of Artificial Sequence: Synthetic oligonucleotide"
auccacuggugaaccaagc

SEQ ID NO: 1076 - RNA, 19 nt, Artificial Sequence
  source: /note="Description of Artificial Sequence: Synthetic oligonucleotide"
aauccacuggugaaccaag

SEQ ID NO: 1077 - RNA, 19 nt, Artificial Sequence
  source: /note="Description of Artificial Sequence: Synthetic oligonucleotide"
auggcacccugcucacgca

SEQ ID NO: 1078 - RNA, 19 nt, Artificial Sequence
  source: /note="Description of Artificial Sequence: Synthetic oligonucleotide"
aauggcacccugcucacgc

SEQ ID NO: 1079 - RNA, 19 nt, Artificial Sequence
  source: /note="Description of Artificial Sequence: Synthetic oligonucleotide"
aacacagaauccacuggug

SEQ ID NO: 1080 - RNA, 19 nt, Artificial Sequence
  source: /note="Description of Artificial Sequence: Synthetic oligonucleotide"
aacaacacagaauccacug

SEQ ID NO: 1081 - RNA, 19 nt, Artificial Sequence
  source: /note="Description of Artificial Sequence: Synthetic oligonucleotide"
aaacaacacagaauccacu

SEQ ID NO: 1082 - RNA, 19 nt, Artificial Sequence
  source: /note="Description of Artificial Sequence: Synthetic oligonucleotide"
aaaacaacacagaauccac

SEQ ID NO: 1083 - RNA, 19 nt, Artificial Sequence
  source: /note="Description of Artificial Sequence: Synthetic oligonucleotide"
uaaaacaacacagaaucca

SEQ ID NO: 1084 - RNA, 19 nt, Artificial Sequence
  source: /note="Description of Artificial Sequence: Synthetic oligonucleotide"
auaaaacaacacagaaucc

SEQ ID NO: 1085 - RNA, 19 nt, Artificial Sequence
  source: /note="Description of Artificial Sequence: Synthetic oligonucleotide"
aauggcauaaaacaacaca

SEQ ID NO: 1086 - RNA, 19 nt, Artificial Sequence
  source: /note="Description of Artificial Sequence: Synthetic oligonucleotide"
uugcugcugugucccaccc

SEQ ID NO: 1087 - RNA, 19 nt, Artificial Sequence
  source: /note="Description of Artificial Sequence: Synthetic oligonucleotide"
uaauggcauaaaacaacac

SEQ ID NO: 1088 - RNA, 19 nt, Artificial Sequence
  source: /note="Description of Artificial Sequence: Synthetic oligonucleotide"
uuguaauggcauaaaacaa

SEQ ID NO: 1089 - RNA, 19 nt, Artificial Sequence
  source: /note="Description of Artificial Sequence: Synthetic oligonucleotide"
uuguggagaguuguaaugg

SEQ ID NO: 1090 - RNA, 19 nt, Artificial Sequence
  source: /note="Description of Artificial Sequence: Synthetic oligonucleotide"
aagguuguggagaguugua

SEQ ID NO: 1091 - RNA, 19 nt, Artificial Sequence
  source: /note="Description of Artificial Sequence: Synthetic oligonucleotide"
aaagguuguggagaguugu

SEQ ID NO: 1092 - RNA, 19 nt, Artificial Sequence
  source: /note="Description of Artificial Sequence: Synthetic oligonucleotide"
aaaagguuguggagaguug

SEQ ID NO: 1093 - RNA, 19 nt, Artificial Sequence
  source: /note="Description of Artificial Sequence: Synthetic oligonucleotide"
uaaaagguuguggagaguu

SEQ ID NO: 1094 - RNA, 19 nt, Artificial Sequence
  source: /note="Description of Artificial Sequence: Synthetic oligonucleotide"
auaaaagguuguggagagu

SEQ ID NO: 1095 - RNA, 19 nt, Artificial Sequence
  source: /note="Description of Artificial Sequence: Synthetic oligonucleotide"
aauaaaagguuguggagag

SEQ ID NO: 1096 - RNA, 19 nt, Artificial Sequence
  source: /note="Description of Artificial Sequence: Synthetic oligonucleotide"
uaauaaaagguuguggaga

SEQ ID NO: 1097 - RNA, 19 nt, Artificial Sequence
  source: /note="Description of Artificial Sequence: Synthetic oligonucleotide"
uugauguaauaaaagguug

SEQ ID NO: 1098 - RNA, 19 nt, Artificial Sequence
  source: /note="Description of Artificial Sequence: Synthetic oligonucleotide"
uucuugauguaauaaaagg

SEQ ID NO: 1099 - RNA, 19 nt, Artificial Sequence
  source: /note="Description of Artificial Sequence: Synthetic oligonucleotide"
uagcuccuucuugauguaa

SEQ ID NO: 1100 - RNA, 19 nt, Artificial Sequence
  source: /note="Description of Artificial Sequence: Synthetic oligonucleotide"
uuagcuccuucuugaugua

SEQ ID NO: 1101 - RNA, 19 nt, Artificial Sequence
  source: /note="Description of Artificial Sequence: Synthetic oligonucleotide"
uuuuagcuccuucuugaug

SEQ ID NO: 1102 - RNA, 19 nt, Artificial Sequence
  source: /note="Description of Artificial Sequence: Synthetic oligonucleotide"
auuuuagcuccuucuugau

SEQ ID NO: 1103 - RNA, 19 nt, Artificial Sequence
  source: /note="Description of Artificial Sequence: Synthetic oligonucleotide"
aacgcacugccauuuuagc

SEQ ID NO: 1104 - RNA, 19 nt, Artificial Sequence
  source: /note="Description of Artificial Sequence: Synthetic oligonucleotide"
uaaacgcacugccauuuua

SEQ ID NO: 1105 - RNA, 19 nt, Artificial Sequence
  source: /note="Description of Artificial Sequence: Synthetic oligonucleotide"
uugagcaaggcaaccauuu

SEQ ID NO: 1106 - RNA, 19 nt, Artificial Sequence
  source: /note="Description of Artificial Sequence: Synthetic oligonucleotide"
uacccucaggggaacaggc

SEQ ID NO: 1107 - RNA, 19 nt, Artificial Sequence
  source: /note="Description of Artificial Sequence: Synthetic oligonucleotide"
uuguugagcaaggcaacca

SEQ ID NO: 1108 - RNA, 19 nt, Artificial Sequence
  source: /note="Description of Artificial Sequence: Synthetic oligonucleotide"
uuuguugagcaaggcaacc

SEQ ID NO: 1109 - RNA, 19 nt, Artificial Sequence
  source: /note="Description of Artificial Sequence: Synthetic oligonucleotide"
uuuuguugagcaaggcaac

SEQ ID NO: 1110 - RNA, 19 nt, Artificial Sequence
  source: /note="Description of Artificial Sequence: Synthetic oligonucleotide"
uuguuuuguugagcaaggc

SEQ ID NO: 1111 - RNA, 19 nt, Artificial Sequence
  source: /note="Description of Artificial Sequence: Synthetic oligonucleotide"
uuuguuuuguugagcaagg

SEQ ID NO: 1112 - RNA, 19 nt, Artificial Sequence
  source: /note="Description of Artificial Sequence: Synthetic oligonucleotide"
uaauagccaagaauuuaac

SEQ ID NO: 1113 - RNA, 19 nt, Artificial Sequence
  source: /note="Description of Artificial Sequence: Synthetic oligonucleotide"
aaggcagucugucguaaua

SEQ ID NO: 1114 - RNA, 19 nt, Artificial Sequence
  source: /note="Description of Artificial Sequence: Synthetic oligonucleotide"
uugcuuucuugguugccau

SEQ ID NO: 1115 - RNA, 19 nt, Artificial Sequence
  source: /note="Description of Artificial Sequence: Synthetic oligonucleotide"
aagcuugggguccaccacu

SEQ ID NO: 1116 - RNA, 19 nt, Artificial Sequence
  source: /note="Description of Artificial Sequence: Synthetic oligonucleotide"
aaagcuugggguccaccac

SEQ ID NO: 1117 - RNA, 19 nt, Artificial Sequence
  source: /note="Description of Artificial Sequence: Synthetic oligonucleotide"
uaaagcuugggguccacca

SEQ ID NO: 1118 - RNA, 19 nt, Artificial Sequence
  source: /note="Description of Artificial Sequence: Synthetic oligonucleotide"
uacuaaagcuuggggucca

SEQ ID NO: 1119 - RNA, 19 nt, Artificial Sequence
  source: /note="Description of Artificial Sequence: Synthetic oligonucleotide"
uuacuaaagcuuggggucc

SEQ ID NO: 1120 - RNA, 19 nt, Artificial Sequence
  source: /note="Description of Artificial Sequence: Synthetic oligonucleotide"
uuuacuaaagcuugggguc

SEQ ID NO: 1121 - RNA, 19 nt, Artificial Sequence
  source: /note="Description of Artificial Sequence: Synthetic oligonucleotide"
auuuacuaaagcuuggggu

SEQ ID NO: 1122 - RNA, 19 nt, Artificial Sequence
  source: /note="Description of Artificial Sequence: Synthetic oligonucleotide"
uauuuacuaaagcuugggg

SEQ ID NO: 1123 - RNA, 19 nt, Artificial Sequence
  source: /note="Description of Artificial Sequence: Synthetic oligonucleotide"
auauuuacuaaagcuuggg

SEQ ID NO: 1124 - RNA, 19 nt, Artificial Sequence
  source: /note="Description of Artificial Sequence: Synthetic oligonucleotide"
uauauuuacuaaagcuugg

SEQ ID NO: 1125 - RNA, 19 nt, Artificial Sequence
  source: /note="Description of Artificial Sequence: Synthetic oligonucleotide"
uagguccucauuauauuua

SEQ ID NO: 1126 - RNA, 19 nt, Artificial Sequence
  source: /note="Description of Artificial Sequence: Synthetic oligonucleotide"
auagguccucauuauauuu

SEQ ID NO: 1127 - RNA, 19 nt, Artificial Sequence
  source: /note="Description of Artificial Sequence: Synthetic oligonucleotide"
uauagguccucauuauauu

SEQ ID NO: 1128 - RNA, 19 nt, Artificial Sequence
  source: /note="Description of Artificial Sequence: Synthetic oligonucleotide"
aaguauagguccucauuau

SEQ ID NO: 1129 - RNA, 19 nt, Artificial Sequence
  source: /note="Description of Artificial Sequence: Synthetic oligonucleotide"
uugugguccacaguaguuu

SEQ ID NO: 1130 - RNA, 19 nt, Artificial Sequence
  source: /note="Description of Artificial Sequence: Synthetic oligonucleotide"
uucagcacucugcuugugg

SEQ ID NO: 1131 - RNA, 19 nt, Artificial Sequence
  source: /note="Description of Artificial Sequence: Synthetic oligonucleotide"
uagcaccuucagcacucug

SEQ ID NO: 1132 - RNA, 19 nt, Artificial Sequence
  source: /note="Description of Artificial Sequence: Synthetic oligonucleotide"
auagcaccuucagcacucu

SEQ ID NO: 1133 - RNA, 19 nt, Artificial Sequence
  source: /note="Description of Artificial Sequence: Synthetic oligonucleotide"
uuccaccagcuucuacaau

SEQ ID NO: 1134 - RNA, 19 nt, Artificial Sequence
  source: /note="Description of Artificial Sequence: Synthetic oligonucleotide"
auuccaccagcuucuacaa

SEQ ID NO: 1135 - RNA, 19 nt, Artificial Sequence
  source: /note="Description of Artificial Sequence: Synthetic oligonucleotide"
aagcuugcauuccaccagc

SEQ ID NO: 1136 - RNA, 19 nt, Artificial Sequence
  source: /note="Description of Artificial Sequence: Synthetic oligonucleotide"
aaagcuugcauuccaccag

SEQ ID NO: 1137 - RNA, 19 nt, Artificial Sequence
  source: /note="Description of Artificial Sequence: Synthetic oligonucleotide"
aucugucaggugaaguccu

SEQ ID NO: 1138 - RNA, 19 nt, Artificial Sequence
  source: /note="Description of Artificial Sequence: Synthetic oligonucleotide"
uuggaucugucaggugaag

SEQ ID NO: 1139 - RNA, 19 nt, Artificial Sequence
  source: /note="Description of Artificial Sequence: Synthetic oligonucleotide"
uugacuuggaucugucagg

SEQ ID NO: 1140 - RNA, 19 nt, Artificial Sequence
  source: /note="Description of Artificial Sequence: Synthetic oligonucleotide"
aagacguugacuuggaucu

SEQ ID NO: 1141 - RNA, 19 nt, Artificial Sequence
  source: /note="Description of Artificial Sequence: Synthetic oligonucleotide"
aacaagacguugacuugga

SEQ ID NO: 1142 - RNA, 19 nt, Artificial Sequence
  source: /note="Description of Artificial Sequence: Synthetic oligonucleotide"
aagacaguucugaacaaga

SEQ ID NO: 1143 - RNA, 19 nt, Artificial Sequence
  source: /note="Description of Artificial Sequence: Synthetic oligonucleotide"
aaagacaguucugaacaag

SEQ ID NO: 1144 - RNA, 19 nt, Artificial Sequence
  source: /note="Description of Artificial Sequence: Synthetic oligonucleotide"
uuccugagaguccaaagac

SEQ ID NO: 1145 - RNA, 19 nt, Artificial Sequence
  source: /note="Description of Artificial Sequence: Synthetic oligonucleotide"
auuccugagaguccaaaga

SEQ ID NO: 1146 - RNA, 19 nt, Artificial Sequence
  source: /note="Description of Artificial Sequence: Synthetic oligonucleotide"
aagauuccugagaguccaa

SEQ ID NO: 1147 - RNA, 19 nt, Artificial Sequence
  source: /note="Description of Artificial Sequence: Synthetic oligonucleotide"
aagggguucucccugggca

SEQ ID NO: 1148 - RNA, 19 nt, Artificial Sequence
  source: /note="Description of Artificial Sequence: Synthetic oligonucleotide"
aaagauuccugagagucca

SEQ ID NO: 1149 - RNA, 19 nt, Artificial Sequence
  source: /note="Description of Artificial Sequence: Synthetic oligonucleotide"
aucugaaagauuccugaga

SEQ ID NO: 1150 - RNA, 19 nt, Artificial Sequence
  source: /note="Description of Artificial Sequence: Synthetic oligonucleotide"
uugcagcaucugaaagauu

SEQ ID NO: 1151 - RNA, 19 nt, Artificial Sequence
  source: /note="Description of Artificial Sequence: Synthetic oligonucleotide"
uaguugcagcaucugaaag

SEQ ID NO: 1152 - RNA, 19 nt, Artificial Sequence
  source: /note="Description of Artificial Sequence: Synthetic oligonucleotide"
uuuaguugcagcaucugaa

SEQ ID NO: 1153 - RNA, 19 nt, Artificial Sequence
  source: /note="Description of Artificial Sequence: Synthetic oligonucleotide"
uuccuguuuaguugcagca

SEQ ID NO: 1154 - RNA, 19 nt, Artificial Sequence
  source: /note="Description of Artificial Sequence: Synthetic oligonucleotide"
uuccaucccuuccuguuua

SEQ ID NO: 1155 - RNA, 19 nt, Artificial Sequence
  source: /note="Description of Artificial Sequence: Synthetic oligonucleotide"
aaggagaccuuccaucccu

SEQ ID NO: 1156 - RNA, 19 nt, Artificial Sequence
  source: /note="Description of Artificial Sequence: Synthetic oligonucleotide"
aagagucccaaggagaccu

SEQ ID NO: 1157 - RNA, 19 nt, Artificial Sequence
  source: /note="Description of Artificial Sequence: Synthetic oligonucleotide"
aacaagagucccaaggaga

SEQ ID NO: 1158 - RNA, 19 nt, Artificial Sequence
  source: /note="Description of Artificial Sequence: Synthetic oligonucleotide"
aagcugaacaagaguccca

SEQ ID NO: 1159 - RNA, 19 nt, Artificial Sequence
  source: /note="Description of Artificial Sequence: Synthetic oligonucleotide"
aacccagaagcugaacaag

SEQ ID NO: 1160 - RNA, 19 nt, Artificial Sequence
  source: /note="Description of Artificial Sequence: Synthetic oligonucleotide"
aucugaacccagaagcuga

SEQ ID NO: 1161 - RNA, 19 nt, Artificial Sequence
  source: /note="Description of Artificial Sequence: Synthetic oligonucleotide"
aucaucugaacccagaagc

SEQ ID NO: 1162 - RNA, 19 nt, Artificial Sequence
  source: /note="Description of Artificial Sequence: Synthetic oligonucleotide"
uaucaucugaacccagaag

SEQ ID NO: 1163 - RNA, 19 nt, Artificial Sequence
  source: /note="Description of Artificial Sequence: Synthetic oligonucleotide"
uacccaaggcauccuggcc

SEQ ID NO: 1164 - RNA, 19 nt, Artificial Sequence
  source: /note="Description of Artificial Sequence: Synthetic oligonucleotide"
auaucaucugaacccagaa

SEQ ID NO: 1165 - RNA, 19 nt, Artificial Sequence
  source: /note="Description of Artificial Sequence: Synthetic oligonucleotide"
uuauaucaucugaacccag

SEQ ID NO: 1166 - RNA, 19 nt, Artificial Sequence
  source: /note="Description of Artificial Sequence: Synthetic oligonucleotide"
uuuauaucaucugaaccca

SEQ ID NO: 1167 - RNA, 19 nt, Artificial Sequence
  source: /note="Description of Artificial Sequence: Synthetic oligonucleotide"
uuccagcugcacaggugac

SEQ ID NO: 1168 - RNA, 19 nt, Artificial Sequence
  source: /note="Description of Artificial Sequence: Synthetic oligonucleotide"
auuccagcugcacagguga

SEQ ID NO: 1169 - RNA, 19 nt, Artificial Sequence
  source: /note="Description of Artificial Sequence: Synthetic oligonucleotide"
aauuccagcugcacaggug

SEQ ID NO: 1170 - RNA, 19 nt, Artificial Sequence
  source: /note="Description of Artificial Sequence: Synthetic oligonucleotide"
aagaauuccagcugcacag

SEQ ID NO: 1171 - RNA, 19 nt, Artificial Sequence
  source: /note="Description of Artificial Sequence: Synthetic oligonucleotide"
aaagaauuccagcugcaca

SEQ ID NO: 1172 - RNA, 19 nt, Artificial Sequence
  source: /note="Description of Artificial Sequence: Synthetic oligonucleotide"
uagaaagaauuccagcugc

SEQ ID NO: 1173 - RNA, 19 nt, Artificial Sequence
  source: /note="Description of Artificial Sequence: Synthetic oligonucleotide"
uuagaaagaauuccagcug

SEQ ID NO: 1174 - RNA, 19 nt, Artificial Sequence
  source: /note="Description of Artificial Sequence: Synthetic oligonucleotide"
uugcaagugagguuagaaa

SEQ ID NO: 1175 - RNA, 19 nt, Artificial Sequence
  source: /note="Description of Artificial Sequence: Synthetic oligonucleotide"
auugcaagugagguuagaa

SEQ ID NO: 1176 - RNA, 19 nt, Artificial Sequence
  source: /note="Description of Artificial Sequence: Synthetic oligonucleotide"
uaauuauugcaagugaggu

SEQ ID NO: 1177 - RNA, 19 nt, Artificial Sequence
  source: /note="Description of Artificial Sequence: Synthetic oligonucleotide"
auaauuauugcaagugagg

SEQ ID NO: 1178 - RNA, 19 nt, Artificial Sequence
  source: /note="Description of Artificial Sequence: Synthetic oligonucleotide"
uauaauuauugcaagugag

SEQ ID NO: 1179 - RNA, 19 nt, Artificial Sequence
  source: /note="Description of Artificial Sequence: Synthetic oligonucleotide"
uaccacccacuuggcagac

SEQ ID NO: 1180 - RNA, 19 nt, Artificial Sequence
  source: /note="Description of Artificial Sequence: Synthetic oligonucleotide"
auaccacccacuuggcaga

SEQ ID NO: 1181 - RNA, 19 nt, Artificial Sequence
  source: /note="Description of Artificial Sequence: Synthetic oligonucleotide"
aagagccucuauaccaccc

SEQ ID NO: 1182 - RNA, 19 nt, Artificial Sequence
  source: /note="Description of Artificial Sequence: Synthetic oligonucleotide"
uacgcacaagagccucuau

SEQ ID NO: 1183 - RNA, 19 nt, Artificial Sequence
  source: /note="Description of Artificial Sequence: Synthetic oligonucleotide"
aaggacaguacgcacaaga

SEQ ID NO: 1184 - RNA, 19 nt, Artificial Sequence
  source: /note="Description of Artificial Sequence: Synthetic oligonucleotide"
augucuucccugucaccag

SEQ ID NO: 1185 - RNA, 19 nt, Artificial Sequence
  source: /note="Description of Artificial Sequence: Synthetic oligonucleotide"
auggcaggcucagugaugu

SEQ ID NO: 1186 - RNA, 19 nt, Artificial Sequence
  source: /note="Description of Artificial Sequence: Synthetic oligonucleotide"
aagagcacagauggcaggc

SEQ ID NO: 1187 - RNA, 19 nt, Artificial Sequence
  source: /note="Description of Artificial Sequence: Synthetic oligonucleotide"
uuggugucggcuggucaga

SEQ ID NO: 1188 - RNA, 19 nt, Artificial Sequence
  source: /note="Description of Artificial Sequence: Synthetic oligonucleotide"
uucuuggugucggcugguc

SEQ ID NO: 1189 - RNA, 19 nt, Artificial Sequence
  source: /note="Description of Artificial Sequence: Synthetic oligonucleotide"
aucucugcuucuugguguc

SEQ ID NO: 1190 - RNA, 19 nt, Artificial Sequence
  source: /note="Description of Artificial Sequence: Synthetic oligonucleotide"
auucugggccaucucugcu

SEQ ID NO: 1191 - RNA, 19 nt, Artificial Sequence
  source: /note="Description of Artificial Sequence: Synthetic oligonucleotide"
aacugcauucugggccauc

SEQ ID NO: 1192 - RNA, 19 nt, Artificial Sequence
  source: /note="Description of Artificial Sequence: Synthetic oligonucleotide"
aaggcgaacugcauucugg

SEQ ID NO: 1193 - RNA, 19 nt, Artificial Sequence
  source: /note="Description of Artificial Sequence: Synthetic oligonucleotide"
uagugaaggcgaacugcau

SEQ ID NO: 1194 - RNA, 19 nt, Artificial Sequence
  source: /note="Description of Artificial Sequence: Synthetic oligonucleotide"
auagugaaggcgaacugca

SEQ ID NO: 1195 - RNA, 19 nt, Artificial Sequence
  source: /note="Description of Artificial Sequence: Synthetic oligonucleotide"
uaguccauagugaaggcga

SEQ ID NO: 1196 - RNA, 19 nt, Artificial Sequence
  source: /note="Description of Artificial Sequence: Synthetic oligonucleotide"
aacugguaguccauaguga

SEQ ID NO: 1197 - RNA, 19 nt, Artificial Sequence
  source: /note="Description of Artificial Sequence: Synthetic oligonucleotide"
aaccacaacugguagucca

SEQ ID NO: 1198 - RNA, 19 nt, Artificial Sequence
  source: /note="Description of Artificial Sequence: Synthetic oligonucleotide"
uaaccacaacugguagucc

SEQ ID NO: 1199 - RNA, 19 nt, Artificial Sequence
  source: /note="Description of Artificial Sequence: Synthetic oligonucleotide"
uuaaccacaacugguaguc

SEQ ID NO: 1200 - RNA, 19 nt, Artificial Sequence
  source: /note="Description of Artificial Sequence: Synthetic oligonucleotide"
aagagcuuaaccacaacug

SEQ ID NO: 1201 - RNA, 19 nt, Artificial Sequence
  source: /note="Description of Artificial Sequence: Synthetic oligonucleotide"
uaagagcuuaaccacaacu

SEQ ID NO: 1202 - RNA, 19 nt, Artificial Sequence
  source: /note="Description of Artificial Sequence: Synthetic oligonucleotide"
augguggguguaagagcuu

SEQ ID NO: 1203 - RNA, 19 nt, Artificial Sequence
  source: /note="Description of Artificial Sequence: Synthetic oligonucleotide"
aucagaggccagugggaug

SEQ ID NO: 1204 - RNA, 19 nt, Artificial Sequence
  source: /note="Description of Artificial Sequence: Synthetic oligonucleotide"
uaucagaggccagugggau

SEQ ID NO: 1205 - RNA, 19 nt, Artificial Sequence
  source: /note="Description of Artificial Sequence: Synthetic oligonucleotide"
uuaucagaggccaguggga

SEQ ID NO: 1206 - RNA, 19 nt, Artificial Sequence
  source: /note="Description of Artificial Sequence: Synthetic oligonucleotide"
uagccuuuaucagaggcca

SEQ ID NO: 1207 - RNA, 19 nt, Artificial Sequence
  source: /note="Description of Artificial Sequence: Synthetic oligonucleotide"
aacaguagccuuuaucaga

SEQ ID NO: 1208 - RNA, 19 nt, Artificial Sequence
  source: /note="Description of Artificial Sequence: Synthetic oligonucleotide"
auccaacaguagccuuuau

SEQ ID NO: 1209 - RNA, 19 nt, Artificial Sequence
  source: /note="Description of Artificial Sequence: Synthetic oligonucleotide"
aaucaauccaacaguagcc

SEQ ID NO: 1210 - RNA, 19 nt, Artificial Sequence
  source: /note="Description of Artificial Sequence: Synthetic oligonucleotide"
auuucgaaucaauccaaca

SEQ ID NO: 1211 - RNA, 19 nt, Artificial Sequence
  source: /note="Description of Artificial Sequence: Synthetic oligonucleotide"
aacuagucguggaauggca

SEQ ID NO: 1212 - RNA, 19 nt, Artificial Sequence
  source: /note="Description of Artificial Sequence: Synthetic oligonucleotide"
aacugaacuagucguggaa

SEQ ID NO: 1213 - RNA, 19 nt, Artificial Sequence
  source: /note="Description of Artificial Sequence: Synthetic oligonucleotide"
aagcaacugaacuagucgu

SEQ ID NO: 1214 - RNA, 19 nt, Artificial Sequence
  source: /note="Description of Artificial Sequence: Synthetic oligonucleotide"
aacaagcaacugaacuagu

SEQ ID NO: 1215 - RNA, 19 nt, Artificial Sequence
  source: /note="Description of Artificial Sequence: Synthetic oligonucleotide"
augugcacgaacaagcaac

SEQ ID NO: 1216 - RNA, 19 nt, Artificial Sequence
  source: /note="Description of Artificial Sequence: Synthetic oligonucleotide"
auccugaugugcacgaaca

SEQ ID NO: 1217 - RNA, 19 nt, Artificial Sequence
  source: /note="Description of Artificial Sequence: Synthetic oligonucleotide"
uauccugaugugcacgaac

SEQ ID NO: 1218 - RNA, 19 nt, Artificial Sequence
  source: /note="Description of Artificial Sequence: Synthetic oligonucleotide"
auugcugcugugucccacc

SEQ ID NO: 1219 - RNA, 19 nt, Artificial Sequence
  source: /note="Description of Artificial Sequence: Synthetic oligonucleotide"
aauugcugcugugucccac

SEQ ID NO: 1220 - RNA, 19 nt, Artificial Sequence
  source: /note="Description of Artificial Sequence: Synthetic oligonucleotide"
aaauugcugcuguguccca

SEQ ID NO: 1221 - RNA, 19 nt, Artificial Sequence
  source: /note="Description of Artificial Sequence: Synthetic oligonucleotide"
uuucuuccaugcggacccc

SEQ ID NO: 1222 - RNA, 19 nt, Artificial Sequence
  source: /note="Description of Artificial Sequence: Synthetic oligonucleotide"
auuucuuccaugcggaccc

SEQ ID NO: 1223 - RNA, 19 nt, Artificial Sequence
  source: /note="Description of Artificial Sequence: Synthetic oligonucleotide"
aucccgagcuaggauguga

SEQ ID NO: 1224 - RNA, 19 nt, Artificial Sequence
  source: /note="Description of Artificial Sequence: Synthetic oligonucleotide"
aacaucccgagcuaggaug

SEQ ID NO: 1225 - RNA, 19 nt, Artificial Sequence
  source: /note="Description of Artificial Sequence: Synthetic oligonucleotide"
uugugaacaucccgagcua

SEQ ID NO: 1226 - RNA, 19 nt, Artificial Sequence
  source: /note="Description of Artificial Sequence: Synthetic oligonucleotide"
auucgguugugaacauccc

SEQ ID NO: 1227 - RNA, 19 nt, Artificial Sequence
  source: /note="Description of Artificial Sequence: Synthetic oligonucleotide"
aauucgguugugaacaucc

SEQ ID NO: 1228 - RNA, 19 nt, Artificial Sequence
  source: /note="Description of Artificial Sequence: Synthetic oligonucleotide"
aaugguauuuaguccucug

SEQ ID NO: 1229 - RNA, 19 nt, Artificial Sequence
  source: /note="Description of Artificial Sequence: Synthetic oligonucleotide"
auggaaugguauuuagucc

SEQ ID NO: 1230 - RNA, 19 nt, Artificial Sequence
  source: /note="Description of Artificial Sequence: Synthetic oligonucleotide"
aacaauggaaugguauuua

SEQ ID NO: 1231 - RNA, 19 nt, Artificial Sequence
  source: /note="Description of Artificial Sequence: Synthetic oligonucleotide"
aaacaauggaaugguauuu

SEQ ID NO: 1232 - RNA, 19 nt, Artificial Sequence
  source: /note="Description of Artificial Sequence: Synthetic oligonucleotide"
aagcagcugcacaaacaau

SEQ ID NO: 1233 - RNA, 19 nt, Artificial Sequence
  source: /note="Description of Artificial Sequence: Synthetic oligonucleotide"
aaagcagcugcacaaacaa

SEQ ID NO: 1234 - RNA, 19 nt, Artificial Sequence
  source: /note="Description of Artificial Sequence: Synthetic oligonucleotide"
uaaagcagcugcacaaaca

SEQ ID NO: 1235 - RNA, 19 nt, Artificial Sequence
  source: /note="Description of Artificial Sequence: Synthetic oligonucleotide"
auaaagcagcugcacaaac

SEQ ID NO: 1236 - RNA, 19 nt, Artificial Sequence
  source: /note="Description of Artificial Sequence: Synthetic oligonucleotide"
aauaaagcagcugcacaaa

SEQ ID NO: 1237 - RNA, 19 nt, Artificial Sequence
  source: /note="Description of Artificial Sequence: Synthetic oligonucleotide"
augggagaauaaagcagcu

SEQ ID NO: 1238 - RNA, 19 nt, Artificial Sequence
  source: /note="Description of Artificial Sequence: Synthetic oligonucleotide"
aaugggagaauaaagcagc

SEQ ID NO: 1239 - RNA, 19 nt, Artificial Sequence
  source: /note="Description of Artificial Sequence: Synthetic oligonucleotide"
uuuucaaugggagaauaaa

SEQ ID NO: 1240 - RNA, 19 nt, Artificial Sequence
  source: /note="Description of Artificial Sequence: Synthetic oligonucleotide"
auguuuucaaugggagaau

SEQ ID NO: 1241 - RNA, 19 nt, Artificial Sequence
  source: /note="Description of Artificial Sequence: Synthetic oligonucleotide"
uuggauguuuucaauggga

SEQ ID NO: 1242 - RNA, 19 nt, Artificial Sequence
  source: /note="Description of Artificial Sequence: Synthetic oligonucleotide"
uucacagaggaccccugca

SEQ ID NO: 1243 - RNA, 19 nt, Artificial Sequence
  source: /note="Description of Artificial Sequence: Synthetic oligonucleotide"
uuccuuguccugagcaagu

SEQ ID NO: 1244 - RNA, 19 nt, Artificial Sequence
  source: /note="Description of Artificial Sequence: Synthetic oligonucleotide"
aacucugucagaggagcug

SEQ ID NO: 1245 - RNA, 19 nt, Artificial Sequence
  source: /note="Description of Artificial Sequence: Synthetic oligonucleotide"
uaacucugucagaggagcu

SEQ ID NO: 1246 - RNA, 19 nt, Artificial Sequence
  source: /note="Description of Artificial Sequence: Synthetic oligonucleotide"
aaguaacucugucagagga

SEQ ID NO: 1247 - RNA, 19 nt, Artificial Sequence
  source: /note="Description of Artificial Sequence: Synthetic oligonucleotide"
uagagugaaguaacucugu

SEQ ID NO: 1248 - RNA, 19 nt, Artificial Sequence
  source: /note="Description of Artificial Sequence: Synthetic oligonucleotide"
uuccuagagugaaguaacu

SEQ ID NO: 1249 - RNA, 19 nt, Artificial Sequence
  source: /note="Description of Artificial Sequence: Synthetic oligonucleotide"
auuccuagagugaaguaac

SEQ ID NO: 1250 - RNA, 19 nt, Artificial Sequence
  source: /note="Description of Artificial Sequence: Synthetic oligonucleotide"
uucauuccuagagugaagu

SEQ ID NO: 1251 - RNA, 19 nt, Artificial Sequence
  source: /note="Description of Artificial Sequence: Synthetic oligonucleotide"
uucggaacaaaacagcagc

SEQ ID NO: 1252 - RNA, 19 nt, Artificial Sequence
  source: /note="Description of Artificial Sequence: Synthetic oligonucleotide"
auucggaacaaaacagcag

SEQ ID NO: 1253 - RNA, 19 nt, Artificial Sequence
  source: /note="Description of Artificial Sequence: Synthetic oligonucleotide"
uuguggcuuguccucagac

SEQ ID NO: 1254 - RNA, 19 nt, Artificial Sequence
  source: /note="Description of Artificial Sequence: Synthetic oligonucleotide"
aucuuguggcuuguccuca

SEQ ID NO: 1255 - RNA, 19 nt, Artificial Sequence
  source: /note="Description of Artificial Sequence: Synthetic oligonucleotide"
uuguaaucuuguggcuugu

SEQ ID NO: 1256 - RNA, 19 nt, Artificial Sequence
  source: /note="Description of Artificial Sequence: Synthetic oligonucleotide"
uucuuguaaucuuguggcu

SEQ ID NO: 1257 - RNA, 19 nt, Artificial Sequence
  source: /note="Description of Artificial Sequence: Synthetic oligonucleotide"
aagccguuucuuguaaucu

SEQ ID NO: 1258 - RNA, 19 nt, Artificial Sequence
  source: /note="Description of Artificial Sequence: Synthetic oligonucleotide"
aacugaaagccguuucuug

SEQ ID NO: 1259 - RNA, 19 nt, Artificial Sequence
  source: /note="Description of Artificial Sequence: Synthetic oligonucleotide"
aagagagagcuggucagcu

SEQ ID NO: 1260 - RNA, 19 nt, Artificial Sequence
  source: /note="Description of Artificial Sequence: Synthetic oligonucleotide"
uucugaagagagagcuggu

SEQ ID NO: 1261 - RNA, 19 nt, Artificial Sequence
  source: /note="Description of Artificial Sequence: Synthetic oligonucleotide"
uucucccugggcaccaaua

SEQ ID NO: 1262 - RNA, 19 nt, Artificial Sequence
  source: /note="Description of Artificial Sequence: Synthetic oligonucleotide"
auccaagggguucucccug

SEQ ID NO: 1263 - RNA, 19 nt, Artificial Sequence
  source: /note="Description of Artificial Sequence: Synthetic oligonucleotide"
uauccaagggguucucccu

SEQ ID NO: 1264 - RNA, 19 nt, Artificial Sequence
  source: /note="Description of Artificial Sequence: Synthetic oligonucleotide"
auccuggcgauauccaagg

SEQ ID NO: 1265 - RNA, 19 nt, Artificial Sequence
  source: /note="Description of Artificial Sequence: Synthetic oligonucleotide"
uaggaucauccuggcgaua

SEQ ID NO: 1266 - RNA, 19 nt, Artificial Sequence
  source: /note="Description of Artificial Sequence: Synthetic oligonucleotide"
uagcuaggaucauccuggc

SEQ ID NO: 1267 - RNA, 19 nt, Artificial Sequence
  source: /note="Description of Artificial Sequence: Synthetic oligonucleotide"
auagcuaggaucauccugg

SEQ ID NO: 1268 - RNA, 19 nt, Artificial Sequence
  source: /note="Description of Artificial Sequence: Synthetic oligonucleotide"
aacgauagcuaggaucauc

SEQ ID NO: 1269 - RNA, 19 nt, Artificial Sequence
  source: /note="Description of Artificial Sequence: Synthetic oligonucleotide"
aaagaacgauagcuaggau

SEQ ID NO: 1270 - RNA, 19 nt, Artificial Sequence
  source: /note="Description of Artificial Sequence: Synthetic oligonucleotide"
aaaagaacgauagcuagga

SEQ ID NO: 1271 - RNA, 19 nt, Artificial Sequence
  source: /note="Description of Artificial Sequence: Synthetic oligonucleotide"
auccaccagagugaaaaga

SEQ ID NO: 1272 - RNA, 19 nt, Artificial Sequence
  source: /note="Description of Artificial Sequence: Synthetic oligonucleotide"
uauccaccagagugaaaag

SEQ ID NO: 1273 - RNA, 19 nt, Artificial Sequence
  source: /note="Description of Artificial Sequence: Synthetic oligonucleotide"
auauccaccagagugaaaa

SEQ ID NO: 1274 - RNA, 19 nt, Artificial Sequence
  source: /note="Description of Artificial Sequence: Synthetic oligonucleotide"
auccuggccauauccacca

SEQ ID NO: 1275 - RNA, 19 nt, Artificial Sequence
  source: /note="Description of Artificial Sequence: Synthetic oligonucleotide"
aaggcauccuggccauauc

SEQ ID NO: 1276 - RNA, 19 nt, Artificial Sequence
  source: /note="Description of Artificial Sequence: Synthetic oligonucleotide"
augggguccauacccaagg

SEQ ID NO: 1277 - RNA, 19 nt, Artificial Sequence
  source: /note="Description of Artificial Sequence: Synthetic oligonucleotide"
aucaugggguccauaccca

SEQ ID NO: 1278 - RNA, 19 nt, Artificial Sequence
  source: /note="Description of Artificial Sequence: Synthetic oligonucleotide"
uaguuaaucaaguuuacaa

SEQ ID NO: 1279 - RNA, 19 nt, Artificial Sequence
  source: /note="Description of Artificial Sequence: Synthetic oligonucleotide"
auaguuaaucaaguuuaca

SEQ ID NO: 1280 - RNA, 19 nt, Artificial Sequence
  source: /note="Description of Artificial Sequence: Synthetic oligonucleotide"
uugauaguuaaucaaguuu

SEQ ID NO: 1281 - RNA, 19 nt, Artificial Sequence
  source: /note="Description of Artificial Sequence: Synthetic oligonucleotide"
uuccaucaugggguccaua

SEQ ID NO: 1282 - RNA, 19 nt, Artificial Sequence
  source: /note="Description of Artificial Sequence: Synthetic oligonucleotide"
auguuccaucauggggucc

SEQ ID NO: 1283 - RNA, 19 nt, Artificial Sequence
  source: /note="Description of Artificial Sequence: Synthetic oligonucleotide"
aucucauguuccaucaugg

SEQ ID NO: 1284 - RNA, 19 nt, Artificial Sequence
  source: /note="Description of Artificial Sequence: Synthetic oligonucleotide"
uagucagcaccaggguggu

SEQ ID NO: 1285 - RNA, 19 nt, Artificial Sequence
  source: /note="Description of Artificial Sequence: Synthetic oligonucleotide"
auagucagcaccagggugg

SEQ ID NO: 1286 - RNA, 19 nt, Artificial Sequence
  source: /note="Description of Artificial Sequence: Synthetic oligonucleotide"
aucaacuggauagucagca

SEQ ID NO: 1287 - RNA, 19 nt, Artificial Sequence
  source: /note="Description of Artificial Sequence: Synthetic oligonucleotide"
aucuggcagcccaucaacu

SEQ ID NO: 1288 - RNA, 19 nt, Artificial Sequence
  source: /note="Description of Artificial Sequence: Synthetic oligonucleotide"
auccaugagguccugggca

SEQ ID NO: 1289 - RNA, 19 nt, Artificial Sequence
  source: /note="Description of Artificial Sequence: Synthetic oligonucleotide"
aaccaggccagcugauugc

SEQ ID NO: 1290 - RNA, 19 nt, Artificial Sequence
  source: /note="Description of Artificial Sequence: Synthetic oligonucleotide"
aaaccaggccagcugauug

SEQ ID NO: 1291 - RNA, 19 nt, Artificial Sequence
  source: /note="Description of Artificial Sequence: Synthetic oligonucleotide"
uacaggucaguaucaaacc

SEQ ID NO: 1292 - RNA, 19 nt, Artificial Sequence
  source: /note="Description of Artificial Sequence: Synthetic oligonucleotide"
augauuuacaggucaguau

SEQ ID NO: 1293 - RNA, 19 nt, Artificial Sequence
  source: /note="Description of Artificial Sequence: Synthetic oligonucleotide"
aaggaugauuuacagguca

SEQ ID NO: 1294 - RNA, 19 nt, Artificial Sequence
  source: /note="Description of Artificial Sequence: Synthetic oligonucleotide"
aaaggaugauuuacagguc

SEQ ID NO: 1295 - RNA, 19 nt, Artificial Sequence
  source: /note="Description of Artificial Sequence: Synthetic oligonucleotide"
uaaaggaugauuuacaggu

SEQ ID NO: 1296 - RNA, 19 nt, Artificial Sequence
  source: /note="Description of Artificial Sequence: Synthetic oligonucleotide"
uuucuacaucauuuguauu

SEQ ID NO: 1297 - RNA, 19 nt, Artificial Sequence
  source: /note="Description of Artificial Sequence: Synthetic oligonucleotide"
auuacagauauucuuaaaa

SEQ ID NO: 1298 - RNA, 19 nt, Artificial Sequence
  source: /note="Description of Artificial Sequence: Synthetic oligonucleotide"
aaaauuagaaauugcugua

SEQ ID NO: 1299 - RNA, 19 nt, Artificial Sequence
  source: /note="Description of Artificial Sequence: Synthetic oligonucleotide"
gagugauuaugaauuagug

SEQ ID NO: 1300 - RNA, 19 nt, Artificial Sequence
  source: /note="Description of Artificial Sequence: Synthetic oligonucleotide"
agagugauuaugaauuagu

SEQ ID NO: 1301 - RNA, 19 nt, Artificial Sequence
  source: /note="Description of Artificial Sequence: Synthetic oligonucleotide"
uuagagugauuaugaauua

SEQ ID NO: 1302 - RNA, 19 nt, Artificial Sequence
  source: /note="Description of Artificial Sequence: Synthetic oligonucleotide"
auuagagugauuaugaauu

SEQ ID NO: 1303 - RNA, 19 nt, Artificial Sequence
  source: /note="Description of Artificial Sequence: Synthetic oligonucleotide"
cuuuauucagauuacaauu

SEQ ID NO: 1304 - RNA, 19 nt, Artificial Sequence
  source: /note="Description of Artificial Sequence: Synthetic oligonucleotide"
uuugucuauuuuauacaaa

SEQ ID NO: 1305 - RNA, 19 nt, Artificial Sequence
  source: /note="Description of Artificial Sequence: Synthetic oligonucleotide"
auuugucuauuuuauacaa

SEQ ID NO: 1306 - RNA, 19 nt, Artificial Sequence
  source: /note="Description of Artificial Sequence: Synthetic oligonucleotide"
uauuugucuauuuuauaca

SEQ ID NO: 1307 - RNA, 19 nt, Artificial Sequence
  source: /note="Description of Artificial Sequence: Synthetic oligonucleotide"
cuauuugucuauuuuauac

SEQ ID NO: 1308 - RNA, 19 nt, Artificial Sequence
  source: /note="Description of Artificial Sequence: Synthetic oligonucleotide"
uucuauuugucuauuuuau

SEQ ID NO: 1309 - RNA, 19 nt, Artificial Sequence
  source: /note="Description of Artificial Sequence: Synthetic oligonucleotide"
uuucuauuugucuauuuua

SEQ ID NO: 1310 - RNA, 19 nt, Artificial Sequence
  source: /note="Description of Artificial Sequence: Synthetic oligonucleotide"
auuuucuauuugucuauuu

SEQ ID NO: 1311 - RNA, 19 nt, Artificial Sequence
  source: /note="Description of Artificial Sequence: Synthetic oligonucleotide"
ccuacccauacauauccca

SEQ ID NO: 1312 - RNA, 19 nt, Artificial Sequence
  source: /note="Description of Artificial Sequence: Synthetic oligonucleotide"
cccuacccauacauauccc

SEQ ID NO: 1313 - RNA, 19 nt, Artificial Sequence
  source: /note="Description of Artificial Sequence: Synthetic oligonucleotide"
uagagugauuaugaauuag

SEQ ID NO: 1314 - RNA, 19 nt, Artificial Sequence
  source: /note="Description of Artificial Sequence: Synthetic oligonucleotide"
auuggaccauuuucuauuu

SEQ ID NO: 1315 - RNA, 19 nt, Artificial Sequence
  source: /note="Description of Artificial Sequence: Synthetic oligonucleotide"
aauuggaccauuuucuauu

SEQ ID NO: 1316 - RNA, 19 nt, Artificial Sequence
  source: /note="Description of Artificial Sequence: Synthetic oligonucleotide"
aacugguaaacuguccaaa

SEQ ID NO: 1317 - RNA, 19 nt, Artificial Sequence
  source: /note="Description of Artificial Sequence: Synthetic oligonucleotide"
aagugagguuagaaagaau

SEQ ID NO: 1318 - RNA, 19 nt, Artificial Sequence
  source: /note="Description of Artificial Sequence: Synthetic oligonucleotide"
aagauuucgaaucaaucca

SEQ ID NO: 1319 - RNA, 12 nt, Artificial Sequence
  source: /note="Description of Artificial Sequence: Synthetic oligonucleotide"
ccuguuccccug

SEQ ID NO: 1320 - RNA, 12 nt, Artificial Sequence
  source: /note="Description of Artificial Sequence: Synthetic oligonucleotide"
cuguuccccuga

SEQ ID NO: 1321 - RNA, 12 nt, Artificial Sequence
  source: /note="Description of Artificial Sequence: Synthetic oligonucleotide"
uguuccccugag

SEQ ID NO: 1322 - RNA, 12 nt, Artificial Sequence
  source: /note="Description of Artificial Sequence: Synthetic oligonucleotide"
guuccccugagg

SEQ ID NO: 1323 - RNA, 12 nt, Artificial Sequence
  source: /note="Description of Artificial Sequence: Synthetic oligonucleotide"
uuccccugaggg

SEQ ID NO: 1324 - RNA, 12 nt, Artificial Sequence
  source: /note="Description of Artificial Sequence: Synthetic oligonucleotide"
uccccugagggu

SEQ ID NO: 1325 - RNA, 12 nt, Artificial Sequence
  source: /note="Description of Artificial Sequence: Synthetic oligonucleotide"
ccccugagggua

SEQ ID NO: 1326 - RNA, 12 nt, Artificial Sequence
  source: /note="Description of Artificial Sequence: Synthetic oligonucleotide"
cccugaggguau

SEQ ID NO: 1327 - RNA, 12 nt, Artificial Sequence
  source: /note="Description of Artificial Sequence: Synthetic oligonucleotide"
ccugaggguauu

SEQ ID NO: 1328 - RNA, 12 nt, Artificial Sequence
  source: /note="Description of Artificial Sequence: Synthetic oligonucleotide"
cugaggguauuu

SEQ ID NO: 1329 - RNA, 12 nt, Artificial Sequence
  source: /note="Description of Artificial Sequence: Synthetic oligonucleotide"
ugaggguauuug

SEQ ID NO: 1330 - RNA, 12 nt, Artificial Sequence
  source: /note="Description of Artificial Sequence: Synthetic oligonucleotide"
gaggguauuuga

SEQ ID NO: 1331 - RNA, 12 nt, Artificial Sequence
  source: /note="Description of Artificial Sequence: Synthetic oligonucleotide"
aggguauuugaa

SEQ ID NO: 1332 - RNA, 12 nt, Artificial Sequence
  source: /note="Description of Artificial Sequence: Synthetic oligonucleotide"
ggguauuugaag

SEQ ID NO: 1333 - RNA, 12 nt, Artificial Sequence
  source: /note="Description of Artificial Sequence: Synthetic oligonucleotide"
gguauuugaagu

SEQ ID NO: 1334 - RNA, 12 nt, Artificial Sequence
  source: /note="Description of Artificial Sequence: Synthetic oligonucleotide"
guauuugaagua

SEQ ID NO: 1335 - RNA, 12 nt, Artificial Sequence
  source: /note="Description of Artificial Sequence: Synthetic oligonucleotide"
uauuugaaguau

SEQ ID NO: 1336 - RNA, 12 nt, Artificial Sequence
  source: /note="Description of Artificial Sequence: Synthetic oligonucleotide"
auuugaaguaua

SEQ ID NO: 1337 - RNA, 12 nt, Artificial Sequence
  source: /note="Description of Artificial Sequence: Synthetic oligonucleotide"
uuugaaguauac

SEQ ID NO: 1338 - RNA, 12 nt, Artificial Sequence
  source: /note="Description of Artificial Sequence: Synthetic oligonucleotide"
uugaaguauacc

SEQ ID NO: 1339 - RNA, 12 nt, Artificial Sequence
  source: /note="Description of Artificial Sequence: Synthetic oligonucleotide"
ugaaguauacca

SEQ ID NO: 1340 - RNA, 12 nt, Artificial Sequence
  source: /note="Description of Artificial Sequence: Synthetic oligonucleotide"
gaaguauaccau

SEQ ID NO: 1341 - RNA, 12 nt, Artificial Sequence
  source: /note="Description of Artificial Sequence: Synthetic oligonucleotide"
aaguauaccaua

SEQ ID NO: 1342 - RNA, 12 nt, Artificial Sequence
  source: /note="Description of Artificial Sequence: Synthetic oligonucleotide"
aguauaccauac

SEQ ID NO: 1343 - RNA, 12 nt, Artificial Sequence
  source: /note="Description of Artificial Sequence: Synthetic oligonucleotide"
guauaccauaca

SEQ ID NO: 1344 - RNA, 12 nt, Artificial Sequence
  source: /note="Description of Artificial Sequence: Synthetic oligonucleotide"
uauaccauacaa

SEQ ID NO: 1345 - RNA, 12 nt, Artificial Sequence
  source: /note="Description of Artificial Sequence: Synthetic oligonucleotide"
auaccauacaac

SEQ ID NO: 1346 - RNA, 12 nt, Artificial Sequence
  source: /note="Description of Artificial Sequence: Synthetic oligonucleotide"
uaccauacaacu

SEQ ID NO: 1347 - RNA, 12 nt, Artificial Sequence
  source: /note="Description of Artificial Sequence: Synthetic oligonucleotide"
accauacaacug

SEQ ID NO: 1348 - RNA, 12 nt, Artificial Sequence
  source: /note="Description of Artificial Sequence: Synthetic oligonucleotide"
ccauacaacugu

SEQ ID NO: 1349 - RNA, 12 nt, Artificial Sequence
  source: /note="Description of Artificial Sequence: Synthetic oligonucleotide"
cauacaacuguu

SEQ ID NO: 1350 - RNA, 12 nt, Artificial Sequence
  source: /note="Description of Artificial Sequence: Synthetic oligonucleotide"
auacaacuguuu

SEQ ID NO: 1351 - RNA, 12 nt, Artificial Sequence
  source: /note="Description of Artificial Sequence: Synthetic oligonucleotide"
uacaacuguuuu

SEQ ID NO: 1352 - RNA, 12 nt, Artificial Sequence
  source: /note="Description of Artificial Sequence: Synthetic oligonucleotide"
acaacuguuuug

SEQ ID NO: 1353 - RNA, 12 nt, Artificial Sequence
  source: /note="Description of Artificial Sequence: Synthetic oligonucleotide"
caacuguuuuga

SEQ ID NO: 1354 - RNA, 12 nt, Artificial Sequence
  source: /note="Description of Artificial Sequence: Synthetic oligonucleotide"
aacuguuuugaa

SEQ ID NO: 1355 - RNA, 12 nt, Artificial Sequence
  source: /note="Description of Artificial Sequence: Synthetic oligonucleotide"
gaaaauccagcg

SEQ ID NO: 1356 - RNA, 12 nt, Artificial Sequence
  source: /note="Description of Artificial Sequence: Synthetic oligonucleotide"
aaaauccagcgu

SEQ ID NO: 1357 - RNA, 12 nt, Artificial Sequence
  source: /note="Description of Artificial Sequence: Synthetic oligonucleotide"
aaauccagcgug

SEQ ID NO: 1358 - RNA, 12 nt, Artificial Sequence
  source: /note="Description of Artificial Sequence: Synthetic oligonucleotide"
aauccagcgugg

SEQ ID NO: 1359 - RNA, 12 nt, Artificial Sequence
  source: /note="Description of Artificial Sequence: Synthetic oligonucleotide"
auccagcgugga

SEQ ID NO: 1360 - RNA, 12 nt, Artificial Sequence
  source: /note="Description of Artificial Sequence: Synthetic oligonucleotide"
uccagcguggac

SEQ ID NO: 1361 - RNA, 12 nt, Artificial Sequence
  source: /note="Description of Artificial Sequence: Synthetic oligonucleotide"
ccagcguggaca

SEQ ID NO: 1362 - RNA, 12 nt, Artificial Sequence
  source: /note="Description of Artificial Sequence: Synthetic oligonucleotide"
cagcguggacaa

SEQ ID NO: 1363 - RNA, 12 nt, Artificial Sequence
  source: /note="Description of Artificial Sequence: Synthetic oligonucleotide"
agcguggacaau

SEQ ID NO: 1364 - RNA, 12 nt, Artificial Sequence
  source: /note="Description of Artificial Sequence: Synthetic oligonucleotide"
guggacaauggc

SEQ ID NO: 1365 - RNA, 12 nt, Artificial Sequence
  source: /note="Description of Artificial Sequence: Synthetic oligonucleotide"
uggacaauggcu

SEQ ID NO: 1366 - RNA, 12 nt, Artificial Sequence
  source: /note="Description of Artificial Sequence: Synthetic oligonucleotide"
ggacaauggcua

SEQ ID NO: 1367 - RNA, 12 nt, Artificial Sequence
  source: /note="Description of Artificial Sequence: Synthetic oligonucleotide"
gacaauggcuac

SEQ ID NO: 1368 - RNA, 12 nt, Artificial Sequence
  source: /note="Description of Artificial Sequence: Synthetic oligonucleotide"
acaauggcuacu

SEQ ID NO: 1369 - RNA, 12 nt, Artificial Sequence
  source: /note="Description of Artificial Sequence: Synthetic oligonucleotide"
caauggcuacuc

SEQ ID NO: 1370 - RNA, 12 nt, Artificial Sequence
  source: /note="Description of Artificial Sequence: Synthetic oligonucleotide"
aauggcuacuca

SEQ ID NO: 1371 - RNA, 12 nt, Artificial Sequence
  source: /note="Description of Artificial Sequence: Synthetic oligonucleotide"
auggcuacucaa

SEQ ID NO: 1372 - RNA, 12 nt, Artificial Sequence
  source: /note="Description of Artificial Sequence: Synthetic oligonucleotide"
uggcuacucaag

SEQ ID NO: 1373 - RNA, 12 nt, Artificial Sequence
  source: /note="Description of Artificial Sequence: Synthetic oligonucleotide"
ggcuacucaagc

SEQ ID NO: 1374 - RNA, 12 nt, Artificial Sequence
  source: /note="Description of Artificial Sequence: Synthetic oligonucleotide"
gcuacucaagcu

SEQ ID NO: 1375 - RNA, 12 nt, Artificial Sequence
  source: /note="Description of Artificial Sequence: Synthetic oligonucleotide"
cuacucaagcug

SEQ ID NO: 1376 - RNA, 12 nt, Artificial Sequence
  source: /note="Description of Artificial Sequence: Synthetic oligonucleotide"
uacucaagcuga

SEQ ID NO: 1377 - RNA, 12 nt, Artificial Sequence
  source: /note="Description of Artificial Sequence: Synthetic oligonucleotide"
acucaagcugau

SEQ ID NO: 1378 - RNA, 12 nt, Artificial Sequence
  source: /note="Description of Artificial Sequence: Synthetic oligonucleotide"
cucaagcugauu

SEQ ID NO: 1379 - RNA, 12 nt, Artificial Sequence
  source: /note="Description of Artificial Sequence: Synthetic oligonucleotide"
ucaagcugauuu

SEQ ID NO: 1380 - RNA, 12 nt, Artificial Sequence
  source: /note="Description of Artificial Sequence: Synthetic oligonucleotide"
uggaguuggaca

SEQ ID NO: 1381 - RNA, 12 nt, Artificial Sequence
  source: /note="Description of Artificial Sequence: Synthetic oligonucleotide"
ggaguuggacau

SEQ ID NO: 1382 - RNA, 12 nt, Artificial Sequence
  source: /note="Description of Artificial Sequence: Synthetic oligonucleotide"
guuggacauggc

SEQ ID NO: 1383 - RNA, 12 nt, Artificial Sequence
  source: /note="Description of Artificial Sequence: Synthetic oligonucleotide"
uuggacauggcc

SEQ ID NO: 1384 - RNA, 12 nt, Artificial Sequence
  source: /note="Description of Artificial Sequence: Synthetic oligonucleotide"
uggacauggcca

SEQ ID NO: 1385 - RNA, 12 nt, Artificial Sequence
  source: /note="Description of Artificial Sequence: Synthetic oligonucleotide"
ggacauggccau

SEQ ID NO: 1386 - RNA, 12 nt, Artificial Sequence
  source: /note="Description of Artificial Sequence: Synthetic oligonucleotide"
cauggaaccaga

SEQ ID NO: 1387 - RNA, 12 nt, Artificial Sequence
  source: /note="Description of Artificial Sequence: Synthetic oligonucleotide"
auggaaccagac

SEQ ID NO: 1388 - RNA, 12 nt, Artificial Sequence
  source: /note="Description of Artificial Sequence: Synthetic oligonucleotide"
uggaaccagaca

SEQ ID NO: 1389 - RNA, 12 nt, Artificial Sequence
  source: /note="Description of Artificial Sequence: Synthetic oligonucleotide"
ggaaccagacag

SEQ ID NO: 1390 - RNA, 12 nt, Artificial Sequence
  source: /note="Description of Artificial Sequence: Synthetic oligonucleotide"
gaaccagacaga

SEQ ID NO: 1391 - RNA, 12 nt, Artificial Sequence
  source: /note="Description of Artificial Sequence: Synthetic oligonucleotide"
aaccagacagaa

SEQ ID NO: 1392 - RNA, 12 nt, Artificial Sequence
  source: /note="Description of Artificial Sequence: Synthetic oligonucleotide"
gacagaaaagcg

SEQ ID NO: 1393 - RNA, 12 nt, Artificial Sequence
  source: /note="Description of Artificial Sequence: Synthetic oligonucleotide"
acagaaaagcgg

SEQ ID NO: 1394 - RNA, 12 nt, Artificial Sequence
  source: /note="Description of Artificial Sequence: Synthetic oligonucleotide"
cagaaaagcggc

SEQ ID NO: 1395 - RNA, 12 nt, Artificial Sequence
  source: /note="Description of Artificial Sequence: Synthetic oligonucleotide"
agaaaagcggcu

SEQ ID NO: 1396 - RNA, 12 nt, Artificial Sequence
  source: /note="Description of Artificial Sequence: Synthetic oligonucleotide"
gaaaagcggcug

SEQ ID NO: 1397 - RNA, 12 nt, Artificial Sequence
  source: /note="Description of Artificial Sequence: Synthetic oligonucleotide"
aaaagcggcugu

SEQ ID NO: 1398 - RNA, 12 nt, Artificial Sequence
  source: /note="Description of Artificial Sequence: Synthetic oligonucleotide"
aaagcggcuguu

SEQ ID NO: 1399 - RNA, 12 nt, Artificial Sequence
  source: /note="Description of Artificial Sequence: Synthetic oligonucleotide"
aagcggcuguua

SEQ ID NO: 1400 - RNA, 12 nt, Artificial Sequence
  source: /note="Description of Artificial Sequence: Synthetic oligonucleotide"
uguuagucacug

SEQ ID NO: 1401 - RNA, 12 nt, Artificial Sequence
  source: /note="Description of Artificial Sequence: Synthetic oligonucleotide"
cacuggcagcaa

SEQ ID NO: 1402 - RNA, 12 nt, Artificial Sequence
  source: /note="Description of Artificial Sequence: Synthetic oligonucleotide"
acuggcagcaac

SEQ ID NO: 1403 - RNA, 12 nt, Artificial Sequence
  source: /note="Description of Artificial Sequence: Synthetic oligonucleotide"
cuggcagcaaca

SEQ ID NO: 1404 - RNA, 12 nt, Artificial Sequence
  source: /note="Description of Artificial Sequence: Synthetic oligonucleotide"
uggcagcaacag

SEQ ID NO: 1405 - RNA, 12 nt, Artificial Sequence
  source: /note="Description of Artificial Sequence: Synthetic oligonucleotide"
ggcagcaacagu

SEQ ID NO: 1406 - RNA, 12 nt, Artificial Sequence
  source: /note="Description of Artificial Sequence: Synthetic oligonucleotide"
gcagcaacaguc

SEQ ID NO: 1407 - RNA, 12 nt, Artificial Sequence
  source: /note="Description of Artificial Sequence: Synthetic oligonucleotide"
cagcaacagucu

SEQ ID NO: 1408 - RNA, 12 nt, Artificial Sequence
  source: /note="Description of Artificial Sequence: Synthetic oligonucleotide"
agcaacagucuu

SEQ ID NO: 1409 - RNA, 12 nt, Artificial Sequence
  source: /note="Description of Artificial Sequence: Synthetic oligonucleotide"
cuuaccuggacu

SEQ ID NO: 1410 - RNA, 12 nt, Artificial Sequence
  source: /note="Description of Artificial Sequence: Synthetic oligonucleotide"
uuaccuggacuc

SEQ ID NO: 1411 - RNA, 12 nt, Artificial Sequence
  source: /note="Description of Artificial Sequence: Synthetic oligonucleotide"
uaccuggacucu

SEQ ID NO: 1412 - RNA, 12 nt, Artificial Sequence
  source: /note="Description of Artificial Sequence: Synthetic oligonucleotide"
accuggacucug

SEQ ID NO: 1413 - RNA, 12 nt, Artificial Sequence
  source: /note="Description of Artificial Sequence: Synthetic oligonucleotide"
ccuggacucugg

SEQ ID NO: 1414 - RNA, 12 nt, Artificial Sequence
  source: /note="Description of Artificial Sequence: Synthetic oligonucleotide"
cuggacucugga

SEQ ID NO: 1415 - RNA, 12 nt, Artificial Sequence
  source: /note="Description of Artificial Sequence: Synthetic oligonucleotide"
uggacucuggaa

SEQ ID NO: 1416 - RNA, 12 nt, Artificial Sequence
  source: /note="Description of Artificial Sequence: Synthetic oligonucleotide"
ggacucuggaau

SEQ ID NO: 1417 - RNA, 12 nt, Artificial Sequence
  source: /note="Description of Artificial Sequence: Synthetic oligonucleotide"
uggaauccauuc

SEQ ID NO: 1418 - RNA, 12 nt, Artificial Sequence
  source: /note="Description of Artificial Sequence: Synthetic oligonucleotide"
ggaauccauucu

SEQ ID NO: 1419 - RNA, 12 nt, Artificial Sequence
  source: /note="Description of Artificial Sequence: Synthetic oligonucleotide"
gaauccauucug

SEQ ID NO: 1420 - RNA, 12 nt, Artificial Sequence
  source: /note="Description of Artificial Sequence: Synthetic oligonucleotide"
aauccauucugg

SEQ ID NO: 1421 - RNA, 12 nt, Artificial Sequence
  source: /note="Description of Artificial Sequence: Synthetic oligonucleotide"
auccauucuggu

SEQ ID NO: 1422 - RNA, 12 nt, Artificial Sequence
  source: /note="Description of Artificial Sequence: Synthetic oligonucleotide"
uccauucuggug

SEQ ID NO: 1423 - RNA, 12 nt, Artificial Sequence
  source: /note="Description of Artificial Sequence: Synthetic oligonucleotide"
ccauucuggugc

SEQ ID NO: 1424 - RNA, 12 nt, Artificial Sequence
  source: /note="Description of Artificial Sequence: Synthetic oligonucleotide"
cucugaguggua

SEQ ID NO: 1425 - RNA, 12 nt, Artificial Sequence
  source: /note="Description of Artificial Sequence: Synthetic oligonucleotide"
ucugagugguaa

SEQ ID NO: 1426 - RNA, 12 nt, Artificial Sequence
  source: /note="Description of Artificial Sequence: Synthetic oligonucleotide"
cugagugguaaa

SEQ ID NO: 1427 - RNA, 12 nt, Artificial Sequence
  source: /note="Description of Artificial Sequence: Synthetic oligonucleotide"
caauccugagga

SEQ ID NO: 1428 - RNA, 12 nt, Artificial Sequence
  source: /note="Description of Artificial Sequence: Synthetic oligonucleotide"
aauccugaggaa

SEQ ID NO: 1429 - RNA, 12 nt, Artificial Sequence
  source: /note="Description of Artificial Sequence: Synthetic oligonucleotide"
ugaggaagagga

SEQ ID NO: 1430 - RNA, 12 nt, Artificial Sequence
  source: /note="Description of Artificial Sequence: Synthetic oligonucleotide"
gaggaagaggau

SEQ ID NO: 1431 - RNA, 12 nt, Artificial Sequence
  source: /note="Description of Artificial Sequence: Synthetic oligonucleotide"
uaccucccaagu

SEQ ID NO: 1432 - RNA, 12 nt, Artificial Sequence
  source: /note="Description of Artificial Sequence: Synthetic oligonucleotide"
accucccaaguc

SEQ ID NO: 1433 - RNA, 12 nt, Artificial Sequence
  source: /note="Description of Artificial Sequence: Synthetic oligonucleotide"
ccucccaagucc

SEQ ID NO: 1434 - RNA, 12 nt, Artificial Sequence
  source: /note="Description of Artificial Sequence: Synthetic oligonucleotide"
cucccaaguccu

SEQ ID NO: 1435 - RNA, 12 nt, Artificial Sequence
  source: /note="Description of Artificial Sequence: Synthetic oligonucleotide"
ucccaaguccug

SEQ ID NO: 1436 - RNA, 12 nt, Artificial Sequence
  source: /note="Description of Artificial Sequence: Synthetic oligonucleotide"
cccaaguccugu

SEQ ID NO: 1437 - RNA, 12 nt, Artificial Sequence
  source: /note="Description of Artificial Sequence: Synthetic oligonucleotide"
ccaaguccugua

SEQ ID NO: 1438 - RNA, 12 nt, Artificial Sequence
  source: /note="Description of Artificial Sequence: Synthetic oligonucleotide"
uaugagugggaa

SEQ ID NO: 1439 - RNA, 12 nt, Artificial Sequence
  source: /note="Description of Artificial Sequence: Synthetic oligonucleotide"
ugagugggaaca

SEQ ID NO: 1440 - RNA, 12 nt, Artificial Sequence
  source: /note="Description of Artificial Sequence: Synthetic oligonucleotide"
gagugggaacag

SEQ ID NO: 1441 - RNA, 12 nt, Artificial Sequence
  source: /note="Description of Artificial Sequence: Synthetic oligonucleotide"
agugggaacagg

SEQ ID NO: 1442 - RNA, 12 nt, Artificial Sequence
  source: /note="Description of Artificial Sequence: Synthetic oligonucleotide"
gugggaacaggg

SEQ ID NO: 1443 - RNA, 12 nt, Artificial Sequence
  source: /note="Description of Artificial Sequence: Synthetic oligonucleotide"
ugggaacaggga

SEQ ID NO: 1444 - RNA, 12 nt, Artificial Sequence
  source: /note="Description of Artificial Sequence: Synthetic oligonucleotide"
gggaacagggau

SEQ ID NO: 1445 - RNA, 12 nt, Artificial Sequence
  source: /note="Description of Artificial Sequence: Synthetic oligonucleotide"
ggaacagggauu

SEQ ID NO: 1446 - RNA, 12 nt, Artificial Sequence
  source: /note="Description of Artificial Sequence: Synthetic oligonucleotide"
gaacagggauuu

SEQ ID NO: 1447 - RNA, 12 nt, Artificial Sequence
  source: /note="Description of Artificial Sequence: Synthetic oligonucleotide"
uucucaguccuu

SEQ ID NO: 1448 - RNA, 12 nt, Artificial Sequence
  source: /note="Description of Artificial Sequence: Synthetic oligonucleotide"
ucaguccuucac

SEQ ID NO: 1449 - RNA, 12 nt, Artificial Sequence
  source: /note="Description of Artificial Sequence: Synthetic oligonucleotide"
caguccuucacu

SEQ ID NO: 1450 - RNA, 12 nt, Artificial Sequence
  source: /note="Description of Artificial Sequence: Synthetic oligonucleotide"
aguccuucacuc

SEQ ID NO: 1451 - RNA, 12 nt, Artificial Sequence
  source: /note="Description of Artificial Sequence: Synthetic oligonucleotide"
guccuucacuca

SEQ ID NO: 1452 - RNA, 12 nt, Artificial Sequence
  source: /note="Description of Artificial Sequence: Synthetic oligonucleotide"
uccuucacucaa

SEQ ID NO: 1453 - RNA, 12 nt, Artificial Sequence
  source: /note="Description of Artificial Sequence: Synthetic oligonucleotide"
cuucacucaaga

SEQ ID NO: 1454 - RNA, 12 nt, Artificial Sequence
  source: /note="Description of Artificial Sequence: Synthetic oligonucleotide"
uucacucaagaa

SEQ ID NO: 1455 - RNA, 12 nt, Artificial Sequence
  source: /note="Description of Artificial Sequence: Synthetic oligonucleotide"
ucaagaacaagu

SEQ ID NO: 1456 - RNA, 12 nt, Artificial Sequence
  source: /note="Description of Artificial Sequence: Synthetic oligonucleotide"
caagaacaagua

SEQ ID NO: 1457 - RNA, 12 nt, Artificial Sequence
  source: /note="Description of Artificial Sequence: Synthetic oligonucleotide"
auugauggacag

SEQ ID NO: 1458 - RNA, 12 nt, Artificial Sequence
  source: /note="Description of Artificial Sequence: Synthetic oligonucleotide"
uugauggacagu

SEQ ID NO: 1459 - RNA, 12 nt, Artificial Sequence
  source: /note="Description of Artificial Sequence: Synthetic oligonucleotide"
ugauggacagua

SEQ ID NO: 1460 - RNA, 12 nt, Artificial Sequence
  source: /note="Description of Artificial Sequence: Synthetic oligonucleotide"
uaugcaaugacu

SEQ ID NO: 1461 - RNA, 12 nt, Artificial Sequence
  source: /note="Description of Artificial Sequence: Synthetic oligonucleotide"
augcaaugacuc

SEQ ID NO: 1462 - RNA, 12 nt, Artificial Sequence
  source: /note="Description of Artificial Sequence: Synthetic oligonucleotide"
ugcaaugacucg

SEQ ID NO: 1463 - RNA, 12 nt, Artificial Sequence
  source: /note="Description of Artificial Sequence: Synthetic oligonucleotide"
gcaaugacucga

SEQ ID NO: 1464 - RNA, 12 nt, Artificial Sequence
  source: /note="Description of Artificial Sequence: Synthetic oligonucleotide"
ucgagcucagag

SEQ ID NO: 1465 - RNA, 12 nt, Artificial Sequence
  source: /note="Description of Artificial Sequence: Synthetic oligonucleotide"
cgagcucagagg

SEQ ID NO: 1466 - RNA, 12 nt, Artificial Sequence
  source: /note="Description of Artificial Sequence: Synthetic oligonucleotide"
gagcucagaggg

SEQ ID NO: 1467 - RNA, 12 nt, Artificial Sequence
  source: /note="Description of Artificial Sequence: Synthetic oligonucleotide"
agcucagagggu

SEQ ID NO: 1468 - RNA, 12 nt, Artificial Sequence
  source: /note="Description of Artificial Sequence: Synthetic oligonucleotide"
gcucagagggua

SEQ ID NO: 1469 - RNA, 12 nt, Artificial Sequence
  source: /note="Description of Artificial Sequence: Synthetic oligonucleotide"
cagaggguacga

SEQ ID NO: 1470 - RNA, 12 nt, Artificial Sequence
  source: /note="Description of Artificial Sequence: Synthetic oligonucleotide"
agaggguacgag

SEQ ID NO: 1471 - RNA, 12 nt, Artificial Sequence
  source: /note="Description of Artificial Sequence: Synthetic oligonucleotide"
gaggguacgagc

SEQ ID NO: 1472 - RNA, 12 nt, Artificial Sequence
  source: /note="Description of Artificial Sequence: Synthetic oligonucleotide"
aggguacgagcu

SEQ ID NO: 1473 - RNA, 12 nt, Artificial Sequence
  source: /note="Description of Artificial Sequence: Synthetic oligonucleotide"
ggguacgagcug

SEQ ID NO: 1474 - RNA, 12 nt, Artificial Sequence
  source: /note="Description of Artificial Sequence: Synthetic oligonucleotide"
gguacgagcugc

SEQ ID NO: 1475 - RNA, 12 nt, Artificial Sequence
  source: /note="Description of Artificial Sequence: Synthetic oligonucleotide"
guacgagcugcu

SEQ ID NO: 1476 - RNA, 12 nt, Artificial Sequence
  source: /note="Description of Artificial Sequence: Synthetic oligonucleotide"
uacgagcugcua

SEQ ID NO: 1477 - RNA, 12 nt, Artificial Sequence
  source: /note="Description of Artificial Sequence: Synthetic oligonucleotide"
acgagcugcuau

SEQ ID NO: 1478 - RNA, 12 nt, Artificial Sequence
  source: /note="Description of Artificial Sequence: Synthetic oligonucleotide"
uauguucccuga

SEQ ID NO: 1479 - RNA, 12 nt, Artificial Sequence
  source: /note="Description of Artificial Sequence: Synthetic oligonucleotide"
auguucccugag

SEQ ID NO: 1480 - RNA, 12 nt, Artificial Sequence
  source: /note="Description of Artificial Sequence: Synthetic oligonucleotide"
uguucccugaga

SEQ ID NO: 1481 - RNA, 12 nt, Artificial Sequence
  source: /note="Description of Artificial Sequence: Synthetic oligonucleotide"
guucccugagac

SEQ ID NO: 1482 - RNA, 12 nt, Artificial Sequence
  source: /note="Description of Artificial Sequence: Synthetic oligonucleotide"
uucccugagaca

SEQ ID NO: 1483 - RNA, 12 nt, Artificial Sequence
  source: /note="Description of Artificial Sequence: Synthetic oligonucleotide"
ucccugagacau

SEQ ID NO: 1484 - RNA, 12 nt, Artificial Sequence
  source: /note="Description of Artificial Sequence: Synthetic oligonucleotide"
cccugagacauu

SEQ ID NO: 1485 - RNA, 12 nt, Artificial Sequence
  source: /note="Description of Artificial Sequence: Synthetic oligonucleotide"
ccugagacauua

SEQ ID NO: 1486 - RNA, 12 nt, Artificial Sequence
  source: /note="Description of Artificial Sequence: Synthetic oligonucleotide"
agaugagggcau

SEQ ID NO: 1487 - RNA, 12 nt, Artificial Sequence
  source: /note="Description of Artificial Sequence: Synthetic oligonucleotide"
gaugagggcaug

SEQ ID NO: 1488 - RNA, 12 nt, Artificial Sequence
  source: /note="Description of Artificial Sequence: Synthetic oligonucleotide"
augagggcaugc

SEQ ID NO: 1489 - RNA, 12 nt, Artificial Sequence
  source: /note="Description of Artificial Sequence: Synthetic oligonucleotide"
ugagggcaugca

SEQ ID NO: 1490 - RNA, 12 nt, Artificial Sequence
  source: /note="Description of Artificial Sequence: Synthetic oligonucleotide"
gagggcaugcag

SEQ ID NO: 1491 - RNA, 12 nt, Artificial Sequence
  source: /note="Description of Artificial Sequence: Synthetic oligonucleotide"
agggcaugcaga

SEQ ID NO: 1492 - RNA, 12 nt, Artificial Sequence
  source: /note="Description of Artificial Sequence: Synthetic oligonucleotide"
gggcaugcagau

SEQ ID NO: 1493 - RNA, 12 nt, Artificial Sequence
  source: /note="Description of Artificial Sequence: Synthetic oligonucleotide"
ggcaugcagauc

SEQ ID NO: 1494 - RNA, 12 nt, Artificial Sequence
  source: /note="Description of Artificial Sequence: Synthetic oligonucleotide"
gcaugcagaucc

SEQ ID NO: 1495 - RNA, 12 nt, Artificial Sequence
  source: /note="Description of Artificial Sequence: Synthetic oligonucleotide"
caugcagauccc

SEQ ID NO: 1496 - RNA, 12 nt, Artificial Sequence
  source: /note="Description of Artificial Sequence: Synthetic oligonucleotide"
augcagauccca

SEQ ID NO: 1497 - RNA, 12 nt, Artificial Sequence
  source: /note="Description of Artificial Sequence: Synthetic oligonucleotide"
ugcagaucccau

SEQ ID NO: 1498 - RNA, 12 nt, Artificial Sequence
  source: /note="Description of Artificial Sequence: Synthetic oligonucleotide"
gcagaucccauc

SEQ ID NO: 1499 - RNA, 12 nt, Artificial Sequence
  source: /note="Description of Artificial Sequence: Synthetic oligonucleotide"
agaucccaucua

SEQ ID NO: 1500 - RNA, 12 nt, Artificial Sequence
  source: /note="Description of Artificial Sequence: Synthetic oligonucleotide"
cccaucuacaca

SEQ ID NO: 1501 - RNA, 12 nt, Artificial Sequence
  source: /note="Description of Artificial Sequence: Synthetic oligonucleotide"
ccaucuacacag

SEQ ID NO: 1502 - RNA, 12 nt, Artificial Sequence
  source: /note="Description of Artificial Sequence: Synthetic oligonucleotide"
caucuacacagu

SEQ ID NO: 1503 - RNA, 12 nt, Artificial Sequence
  source: /note="Description of Artificial Sequence: Synthetic oligonucleotide"
aucuacacaguu

SEQ ID NO: 1504 - RNA, 12 nt, Artificial Sequence
  source: /note="Description of Artificial Sequence: Synthetic oligonucleotide"
gaugcugcucau

SEQ ID NO: 1505 - RNA, 12 nt, Artificial Sequence
  source: /note="Description of Artificial Sequence: Synthetic oligonucleotide"
augcugcucauc

SEQ ID NO: 1506 - RNA, 12 nt, Artificial Sequence
  source: /note="Description of Artificial Sequence: Synthetic oligonucleotide"
ugcugcucaucc

SEQ ID NO: 1507 - RNA, 12 nt, Artificial Sequence
  source: /note="Description of Artificial Sequence: Synthetic oligonucleotide"
gcugcucauccc

SEQ ID NO: 1508 - RNA, 12 nt, Artificial Sequence
  source: /note="Description of Artificial Sequence: Synthetic oligonucleotide"
cugcucauccca

SEQ ID NO: 1509 - RNA, 12 nt, Artificial Sequence
  source: /note="Description of Artificial Sequence: Synthetic oligonucleotide"
ugcucaucccac

SEQ ID NO: 1510 - RNA, 12 nt, Artificial Sequence
  source: /note="Description of Artificial Sequence: Synthetic oligonucleotide"
gcucaucccacu

SEQ ID NO: 1511 - RNA, 12 nt, Artificial Sequence
  source: /note="Description of Artificial Sequence: Synthetic oligonucleotide"
cucaucccacua

SEQ ID NO: 1512 - RNA, 12 nt, Artificial Sequence
  source: /note="Description of Artificial Sequence: Synthetic oligonucleotide"
ucaucccacuaa

SEQ ID NO: 1513 - RNA, 12 nt, Artificial Sequence
  source: /note="Description of Artificial Sequence: Synthetic oligonucleotide"
caucccacuaau

SEQ ID NO: 1514 - RNA, 12 nt, Artificial Sequence
  source: /note="Description of Artificial Sequence: Synthetic oligonucleotide"
aucccacuaaug

SEQ ID NO: 1515 - RNA, 12 nt, Artificial Sequence
  source: /note="Description of Artificial Sequence: Synthetic oligonucleotide"
ucccacuaaugu

SEQ ID NO: 1516 - RNA, 12 nt, Artificial Sequence
  source: /note="Description of Artificial Sequence: Synthetic oligonucleotide"
cccacuaauguc

SEQ ID NO: 1517 - RNA, 12 nt, Artificial Sequence
  source: /note="Description of Artificial Sequence: Synthetic oligonucleotide"
ccacuaaugucc

SEQ ID NO: 1518 - RNA, 12 nt, Artificial Sequence
  source: /note="Description of Artificial Sequence: Synthetic oligonucleotide"
cacuaaugucca

SEQ ID NO: 1519 - RNA, 12 nt, Artificial Sequence
  source: /note="Description of Artificial Sequence: Synthetic oligonucleotide"
acuaauguccag

SEQ ID NO: 1520 - RNA, 12 nt, Artificial Sequence
  source: /note="Description of Artificial Sequence: Synthetic oligonucleotide"
cuaauguccagc

SEQ ID NO: 1521 - RNA, 12 nt, Artificial Sequence
  source: /note="Description of Artificial Sequence: Synthetic oligonucleotide"
uaauguccagcg

SEQ ID NO: 1522 - RNA, 12 nt, Artificial Sequence
  source: /note="Description of Artificial Sequence: Synthetic oligonucleotide"
gcguuuggcuga

SEQ ID NO: 1523 - RNA, 12 nt, Artificial Sequence
  source: /note="Description of Artificial Sequence: Synthetic oligonucleotide"
cguuuggcugaa

SEQ ID NO: 1524 - RNA, 12 nt, Artificial Sequence
  source: /note="Description of Artificial Sequence: Synthetic oligonucleotide"
guuuggcugaac

SEQ ID NO: 1525 - RNA, 12 nt, Artificial Sequence
  source: /note="Description of Artificial Sequence: Synthetic oligonucleotide"
uuuggcugaacc

SEQ ID NO: 1526 - RNA, 12 nt, Artificial Sequence
  source: /note="Description of Artificial Sequence: Synthetic oligonucleotide"
uuggcugaacca

SEQ ID NO: 1527 - RNA, 12 nt, Artificial Sequence
  source: /note="Description of Artificial Sequence: Synthetic oligonucleotide"
uggcugaaccau

SEQ ID NO: 1528 - RNA, 12 nt, Artificial Sequence
  source: /note="Description of Artificial Sequence: Synthetic oligonucleotide"
ggcugaaccauc

SEQ ID NO: 1529 - RNA, 12 nt, Artificial Sequence
  source: /note="Description of Artificial Sequence: Synthetic oligonucleotide"
gcugaaccauca

SEQ ID NO: 1530 - RNA, 12 nt, Artificial Sequence
  source: /note="Description of Artificial Sequence: Synthetic oligonucleotide"
cugaaccaucac

SEQ ID NO: 1531 - RNA, 12 nt, Artificial Sequence
  source: /note="Description of Artificial Sequence: Synthetic oligonucleotide"
ugaaccaucaca

SEQ ID NO: 1532 - RNA, 12 nt, Artificial Sequence
  source: /note="Description of Artificial Sequence: Synthetic oligonucleotide"
gaaccaucacag

SEQ ID NO: 1533 - RNA, 12 nt, Artificial Sequence
  source: /note="Description of Artificial Sequence: Synthetic oligonucleotide"
aaccaucacaga

SEQ ID NO: 1534 - RNA, 12 nt, Artificial Sequence
  source: /note="Description of Artificial Sequence: Synthetic oligonucleotide"
accaucacagau

SEQ ID NO: 1535 - RNA, 12 nt, Artificial Sequence
  source: /note="Description of Artificial Sequence: Synthetic oligonucleotide"
ccaucacagaug

SEQ ID NO: 1536 - RNA, 12 nt, Artificial Sequence
  source: /note="Description of Artificial Sequence: Synthetic oligonucleotide"
caucacagaugc

SEQ ID NO: 1537 - RNA, 12 nt, Artificial Sequence
  source: /note="Description of Artificial Sequence: Synthetic oligonucleotide"
aucacagaugcu

SEQ ID NO: 1538 - RNA, 12 nt, Artificial Sequence
  source: /note="Description of Artificial Sequence: Synthetic oligonucleotide"
ucacagaugcug

SEQ ID NO: 1539 - RNA, 12 nt, Artificial Sequence
  source: /note="Description of Artificial Sequence: Synthetic oligonucleotide"
cacagaugcuga

SEQ ID NO: 1540 - RNA, 12 nt, Artificial Sequence
  source: /note="Description of Artificial Sequence: Synthetic oligonucleotide"
acagaugcugaa

SEQ ID NO: 1541 - RNA, 12 nt, Artificial Sequence
  source: /note="Description of Artificial Sequence: Synthetic oligonucleotide"
cagaugcugaaa

SEQ ID NO: 1542 - RNA, 12 nt, Artificial Sequence
  source: /note="Description of Artificial Sequence: Synthetic oligonucleotide"
gaugcugaaaca

SEQ ID NO: 1543 - RNA, 12 nt, Artificial Sequence
  source: /note="Description of Artificial Sequence: Synthetic oligonucleotide"
augcugaaacau

SEQ ID NO: 1544 - RNA, 12 nt, Artificial Sequence
  source: /note="Description of Artificial Sequence: Synthetic oligonucleotide"
cugaaacaugca

SEQ ID NO: 1545 - RNA, 12 nt, Artificial Sequence
  source: /note="Description of Artificial Sequence: Synthetic oligonucleotide"
ugaaacaugcag

SEQ ID NO: 1546 - RNA, 12 nt, Artificial Sequence
  source: /note="Description of Artificial Sequence: Synthetic oligonucleotide"
gaaacaugcagu

SEQ ID NO: 1547 - RNA, 12 nt, Artificial Sequence
  source: /note="Description of Artificial Sequence: Synthetic oligonucleotide"
aaacaugcaguu

SEQ ID NO: 1548 - RNA, 12 nt, Artificial Sequence
  source: /note="Description of Artificial Sequence: Synthetic oligonucleotide"
aacaugcaguug

SEQ ID NO: 1549 - RNA, 12 nt, Artificial Sequence
  source: /note="Description of Artificial Sequence: Synthetic oligonucleotide"
acaugcaguugu

SEQ ID NO: 1550 - RNA, 12 nt, Artificial Sequence
  source: /note="Description of Artificial Sequence: Synthetic oligonucleotide"
caugcaguugua

SEQ ID NO: 1551 - RNA, 12 nt, Artificial Sequence
  source: /note="Description of Artificial Sequence: Synthetic oligonucleotide"
augcaguuguaa

SEQ ID NO: 1552 - RNA, 12 nt, Artificial Sequence
  source: /note="Description of Artificial Sequence: Synthetic oligonucleotide"
ugcaguuguaaa

SEQ ID NO: 1553 - RNA, 12 nt, Artificial Sequence
  source: /note="Description of Artificial Sequence: Synthetic oligonucleotide"
gcaguuguaaac

SEQ ID NO: 1554 - RNA, 12 nt, Artificial Sequence
  source: /note="Description of Artificial Sequence: Synthetic oligonucleotide"
caguuguaaacu

SEQ ID NO: 1555 - RNA, 12 nt, Artificial Sequence
  source: /note="Description of Artificial Sequence: Synthetic oligonucleotide"
aguuguaaacuu

SEQ ID NO: 1556 - RNA, 12 nt, Artificial Sequence
  source: /note="Description of Artificial Sequence: Synthetic oligonucleotide"
guuguaaacuug

SEQ ID NO: 1557 - RNA, 12 nt, Artificial Sequence
  source: /note="Description of Artificial Sequence: Synthetic oligonucleotide"
uuguaaacuuga

SEQ ID NO: 1558 - RNA, 12 nt, Artificial Sequence
  source: /note="Description of Artificial Sequence: Synthetic oligonucleotide"
uguaaacuugau

SEQ ID NO: 1559 - RNA, 12 nt, Artificial Sequence
  source: /note="Description of Artificial Sequence: Synthetic oligonucleotide"
guaaacuugauu

SEQ ID NO: 1560 - RNA, 12 nt, Artificial Sequence
  source: /note="Description of Artificial Sequence: Synthetic oligonucleotide"
uaaacuugauua

SEQ ID NO: 1561 - RNA, 12 nt, Artificial Sequence
  source: /note="Description of Artificial Sequence: Synthetic oligonucleotide"
aaacuugauuaa

SEQ ID NO: 1562 - RNA, 12 nt, Artificial Sequence
  source: /note="Description of Artificial Sequence: Synthetic oligonucleotide"
aacuugauuaac

SEQ ID NO: 1563 - RNA, 12 nt, Artificial Sequence
  source: /note="Description of Artificial Sequence: Synthetic oligonucleotide"
acuugauuaacu

SEQ ID NO: 1564 - RNA, 12 nt, Artificial Sequence
  source: /note="Description of Artificial Sequence: Synthetic oligonucleotide"
cuugauuaacua

SEQ ID NO: 1565 - RNA, 12 nt, Artificial Sequence
  source: /note="Description of Artificial Sequence: Synthetic oligonucleotide"
uugauuaacuau

SEQ ID NO: 1566 - RNA, 12 nt, Artificial Sequence
  source: /note="Description of Artificial Sequence: Synthetic oligonucleotide"
ugauuaacuauc

SEQ ID NO: 1567 - RNA, 12 nt, Artificial Sequence
  source: /note="Description of Artificial Sequence: Synthetic oligonucleotide"
gauuaacuauca

SEQ ID NO: 1568 - RNA, 12 nt, Artificial Sequence
  source: /note="Description of Artificial Sequence: Synthetic oligonucleotide"
auuaacuaucaa

SEQ ID NO: 1569 - RNA, 12 nt, Artificial Sequence
  source: /note="Description of Artificial Sequence: Synthetic oligonucleotide"
uuaacuaucaag

SEQ ID NO: 1570 - RNA, 12 nt, Artificial Sequence
  source: /note="Description of Artificial Sequence: Synthetic oligonucleotide"
uaacuaucaaga

SEQ ID NO: 1571 - RNA, 12 nt, Artificial Sequence
  source: /note="Description of Artificial Sequence: Synthetic oligonucleotide"
aacuaucaagau

SEQ ID NO: 1572 - RNA, 12 nt, Artificial Sequence
  source: /note="Description of Artificial Sequence: Synthetic oligonucleotide"
cuaucaagauga

SEQ ID NO: 1573 - RNA, 12 nt, Artificial Sequence
  source: /note="Description of Artificial Sequence: Synthetic oligonucleotide"
uaucaagaugau

SEQ ID NO: 1574 - RNA, 12 nt, Artificial Sequence
  source: /note="Description of Artificial Sequence: Synthetic oligonucleotide"
aacuugccacac

SEQ ID NO: 1575 - RNA, 12 nt, Artificial Sequence
  source: /note="Description of Artificial Sequence: Synthetic oligonucleotide"
acuugccacacg

SEQ ID NO: 1576 - RNA, 12 nt, Artificial Sequence
  source: /note="Description of Artificial Sequence: Synthetic oligonucleotide"
cuugccacacgu

SEQ ID NO: 1577 - RNA, 12 nt, Artificial Sequence
  source: /note="Description of Artificial Sequence: Synthetic oligonucleotide"
uugccacacgug

SEQ ID NO: 1578 - RNA, 12 nt, Artificial Sequence
  source: /note="Description of Artificial Sequence: Synthetic oligonucleotide"
ugccacacgugc

SEQ ID NO: 1579 - RNA, 12 nt, Artificial Sequence
  source: /note="Description of Artificial Sequence: Synthetic oligonucleotide"
gccacacgugca

SEQ ID NO: 1580 - RNA, 12 nt, Artificial Sequence
  source: /note="Description of Artificial Sequence: Synthetic oligonucleotide"
ccacacgugcaa

SEQ ID NO: 1581 - RNA, 12 nt, Artificial Sequence
  source: /note="Description of Artificial Sequence: Synthetic oligonucleotide"
cacacgugcaau

SEQ ID NO: 1582 - RNA, 12 nt, Artificial Sequence
  source: /note="Description of Artificial Sequence: Synthetic oligonucleotide"
gcaaucccugaa

SEQ ID NO: 1583 - RNA, 12 nt, Artificial Sequence
  source: /note="Description of Artificial Sequence: Synthetic oligonucleotide"
caaucccugaac

SEQ ID NO: 1584 - RNA, 12 nt, Artificial Sequence
  source: /note="Description of Artificial Sequence: Synthetic oligonucleotide"
aaucccugaacu

SEQ ID NO: 1585 - RNA, 12 nt, Artificial Sequence
  source: /note="Description of Artificial Sequence: Synthetic oligonucleotide"
aucccugaacug

SEQ ID NO: 1586 - RNA, 12 nt, Artificial Sequence
  source: /note="Description of Artificial Sequence: Synthetic oligonucleotide"
ucccugaacuga

SEQ ID NO: 1587 - RNA, 12 nt, Artificial Sequence
  source: /note="Description of Artificial Sequence: Synthetic oligonucleotide"
cccugaacugac

SEQ ID NO: 1588 - RNA, 12 nt, Artificial Sequence
  source: /note="Description of Artificial Sequence: Synthetic oligonucleotide"
ccugaacugaca

SEQ ID NO: 1589 - RNA, 12 nt, Artificial Sequence
  source: /note="Description of Artificial Sequence: Synthetic oligonucleotide"
cugaacugacaa

SEQ ID NO: 1590 - RNA, 12 nt, Artificial Sequence
  source: /note="Description of Artificial Sequence: Synthetic oligonucleotide"
ugaacugacaaa

SEQ ID NO: 1591 - RNA, 12 nt, Artificial Sequence
  source: /note="Description of Artificial Sequence: Synthetic oligonucleotide"
gaacugacaaaa

SEQ ID NO: 1592 - RNA, 12 nt, Artificial Sequence
  source: /note="Description of Artificial Sequence: Synthetic oligonucleotide"
aacugacaaaac

SEQ ID NO: 1593 - RNA, 12 nt, Artificial Sequence
  source: /note="Description of Artificial Sequence: Synthetic oligonucleotide"
acugacaaaacu

SEQ ID NO: 1594 - RNA, 12 nt, Artificial Sequence
  source: /note="Description of Artificial Sequence: Synthetic oligonucleotide"
cugacaaaacug

SEQ ID NO: 1595 - RNA, 12 nt, Artificial Sequence
  source: /note="Description of Artificial Sequence: Synthetic oligonucleotide"
ugacaaaacugc

SEQ ID NO: 1596 - RNA, 12 nt, Artificial Sequence
  source: /note="Description of Artificial Sequence: Synthetic oligonucleotide"
gacaaaacugcu

SEQ ID NO: 1597 - RNA, 12 nt, Artificial Sequence
  source: /note="Description of Artificial Sequence: Synthetic oligonucleotide"
acaaaacugcua

SEQ ID NO: 1598 - RNA, 12 nt, Artificial Sequence
  source: /note="Description of Artificial Sequence: Synthetic oligonucleotide"
caaaacugcuaa

SEQ ID NO: 1599 - RNA, 12 nt, Artificial Sequence
  source: /note="Description of Artificial Sequence: Synthetic oligonucleotide"
aaaacugcuaaa

SEQ ID NO: 1600 - RNA, 12 nt, Artificial Sequence
  source: /note="Description of Artificial Sequence: Synthetic oligonucleotide"
aggaccaggugg

SEQ ID NO: 1601 - RNA, 12 nt, Artificial Sequence
  source: /note="Description of Artificial Sequence: Synthetic oligonucleotide"
ggaccagguggu

SEQ ID NO: 1602 - RNA, 12 nt, Artificial Sequence
  source: /note="Description of Artificial Sequence: Synthetic oligonucleotide"
gaccagguggug

SEQ ID NO: 1603 - RNA, 12 nt, Artificial Sequence
  source: /note="Description of Artificial Sequence: Synthetic oligonucleotide"
accagguggugg

SEQ ID NO: 1604 - RNA, 12 nt, Artificial Sequence
  source: /note="Description of Artificial Sequence: Synthetic oligonucleotide"
ccaggugguggu

SEQ ID NO: 1605 - RNA, 12 nt, Artificial Sequence
  source: /note="Description of Artificial Sequence: Synthetic oligonucleotide"
cagguggugguu

SEQ ID NO: 1606 - RNA, 12 nt, Artificial Sequence
  source: /note="Description of Artificial Sequence: Synthetic oligonucleotide"
agguggugguua

SEQ ID NO: 1607 - RNA, 12 nt, Artificial Sequence
  source: /note="Description of Artificial Sequence: Synthetic oligonucleotide"
gguggugguuaa

SEQ ID NO: 1608 - RNA, 12 nt, Artificial Sequence
  source: /note="Description of Artificial Sequence: Synthetic oligonucleotide"
guggugguuaau

SEQ ID NO: 1609 - RNA, 12 nt, Artificial Sequence
  source: /note="Description of Artificial Sequence: Synthetic oligonucleotide"
uggugguuaaua

SEQ ID NO: 1610 - RNA, 12 nt, Artificial Sequence
  source: /note="Description of Artificial Sequence: Synthetic oligonucleotide"
guuaugguccau

SEQ ID NO: 1611 - RNA, 12 nt, Artificial Sequence
  source: /note="Description of Artificial Sequence: Synthetic oligonucleotide"
augguccaucag

SEQ ID NO: 1612 - RNA, 12 nt, Artificial Sequence
  source: /note="Description of Artificial Sequence: Synthetic oligonucleotide"
ugguccaucagc

SEQ ID NO: 1613 - RNA, 12 nt, Artificial Sequence
  source: /note="Description of Artificial Sequence: Synthetic oligonucleotide"
gguccaucagcu

SEQ ID NO: 1614 - RNA, 12 nt, Artificial Sequence
  source: /note="Description of Artificial Sequence: Synthetic oligonucleotide"
guccaucagcuu

SEQ ID NO: 1615 - RNA, 12 nt, Artificial Sequence
  source: /note="Description of Artificial Sequence: Synthetic oligonucleotide"
uccaucagcuuu

SEQ ID NO: 1616 - RNA, 12 nt, Artificial Sequence
  source: /note="Description of Artificial Sequence: Synthetic oligonucleotide"
ccaucagcuuuc

SEQ ID NO: 1617 - RNA, 12 nt, Artificial Sequence
  source: /note="Description of Artificial Sequence: Synthetic oligonucleotide"
caucagcuuucu

SEQ ID NO: 1618 - RNA, 12 nt, Artificial Sequence
  source: /note="Description of Artificial Sequence: Synthetic oligonucleotide"
aucagcuuucua

SEQ ID NO: 1619 - RNA, 12 nt, Artificial Sequence
  source: /note="Description of Artificial Sequence: Synthetic oligonucleotide"
ucagcuuucuaa

SEQ ID NO: 1620 - RNA, 12 nt, Artificial Sequence
  source: /note="Description of Artificial Sequence: Synthetic oligonucleotide"
cagcuuucuaaa

SEQ ID NO: 1621 - RNA, 12 nt, Artificial Sequence
  source: /note="Description of Artificial Sequence: Synthetic oligonucleotide"
gaagcuuccaga

SEQ ID NO: 1622 - RNA, 12 nt, Artificial Sequence
  source: /note="Description of Artificial Sequence: Synthetic oligonucleotide"
aagcuuccagac

SEQ ID NO: 1623 - RNA, 12 nt, Artificial Sequence
  source: /note="Description of Artificial Sequence: Synthetic oligonucleotide"
agcuuccagaca

SEQ ID NO: 1624 - RNA, 12 nt, Artificial Sequence
  source: /note="Description of Artificial Sequence: Synthetic oligonucleotide"
gcuuccagacac

SEQ ID NO: 1625 - RNA, 12 nt, Artificial Sequence
  source: /note="Description of Artificial Sequence: Synthetic oligonucleotide"
cuuccagacacg

SEQ ID NO: 1626 - RNA, 12 nt, Artificial Sequence
  source: /note="Description of Artificial Sequence: Synthetic oligonucleotide"
uuccagacacgc

SEQ ID NO: 1627 - RNA, 12 nt, Artificial Sequence
  source: /note="Description of Artificial Sequence: Synthetic oligonucleotide"
uccagacacgcu

SEQ ID NO: 1628 - RNA, 12 nt, Artificial Sequence
  source: /note="Description of Artificial Sequence: Synthetic oligonucleotide"
ccagacacgcua

SEQ ID NO: 1629 - RNA, 12 nt, Artificial Sequence
  source: /note="Description of Artificial Sequence: Synthetic oligonucleotide"
cagacacgcuau

SEQ ID NO: 1630 - RNA, 12 nt, Artificial Sequence
  source: /note="Description of Artificial Sequence: Synthetic oligonucleotide"
agacacgcuauc

SEQ ID NO: 1631 - RNA, 12 nt, Artificial Sequence
  source: /note="Description of Artificial Sequence: Synthetic oligonucleotide"
gacacgcuauca

SEQ ID NO: 1632 - RNA, 12 nt, Artificial Sequence
  source: /note="Description of Artificial Sequence: Synthetic oligonucleotide"
acacgcuaucau

SEQ ID NO: 1633 - RNA, 12 nt, Artificial Sequence
  source: /note="Description of Artificial Sequence: Synthetic oligonucleotide"
cacgcuaucaug

SEQ ID NO: 1634 - RNA, 12 nt, Artificial Sequence
  source: /note="Description of Artificial Sequence: Synthetic oligonucleotide"
acgcuaucaugc

SEQ ID NO: 1635 - RNA, 12 nt, Artificial Sequence
  source: /note="Description of Artificial Sequence: Synthetic oligonucleotide"
cgcuaucaugcg

SEQ ID NO: 1636 - RNA, 12 nt, Artificial Sequence
  source: /note="Description of Artificial Sequence: Synthetic oligonucleotide"
gcuaucaugcgu

SEQ ID NO: 1637 - RNA, 12 nt, Artificial Sequence
  source: /note="Description of Artificial Sequence: Synthetic oligonucleotide"
cuaucaugcguu

SEQ ID NO: 1638 - RNA, 12 nt, Artificial Sequence
  source: /note="Description of Artificial Sequence: Synthetic oligonucleotide"
uaucaugcguuc

SEQ ID NO: 1639 - RNA, 12 nt, Artificial Sequence
  source: /note="Description of Artificial Sequence: Synthetic oligonucleotide"
aucaugcguucu

SEQ ID NO: 1640 - RNA, 12 nt, Artificial Sequence
  source: /note="Description of Artificial Sequence: Synthetic oligonucleotide"
ucaugcguucuc

SEQ ID NO: 1641 - RNA, 12 nt, Artificial Sequence
  source: /note="Description of Artificial Sequence: Synthetic oligonucleotide"
caugcguucucc

SEQ ID NO: 1642 - RNA, 12 nt, Artificial Sequence
  source: /note="Description of Artificial Sequence: Synthetic oligonucleotide"
augcguucuccu

SEQ ID NO: 1643 - RNA, 12 nt, Artificial Sequence
  source: /note="Description of Artificial Sequence: Synthetic oligonucleotide"
cucagauggugu

SEQ ID NO: 1644 - RNA, 12 nt, Artificial Sequence
  source: /note="Description of Artificial Sequence: Synthetic oligonucleotide"
ucagaugguguc

SEQ ID NO: 1645 - RNA, 12 nt, Artificial Sequence
  source: /note="Description of Artificial Sequence: Synthetic oligonucleotide"
cagauggugucu

SEQ ID NO: 1646 - RNA, 12 nt, Artificial Sequence
  source: /note="Description of Artificial Sequence: Synthetic oligonucleotide"
agauggugucug

SEQ ID NO: 1647 - RNA, 12 nt, Artificial Sequence
  source: /note="Description of Artificial Sequence: Synthetic oligonucleotide"
gauggugucugc

SEQ ID NO: 1648 - RNA, 12 nt, Artificial Sequence
  source: /note="Description of Artificial Sequence: Synthetic oligonucleotide"
auggugucugcu

SEQ ID NO: 1649 - RNA, 12 nt, Artificial Sequence
  source: /note="Description of Artificial Sequence: Synthetic oligonucleotide"
uggugucugcua

SEQ ID NO: 1650 - RNA, 12 nt, Artificial Sequence
  source: /note="Description of Artificial Sequence: Synthetic oligonucleotide"
cugcuauuguac

SEQ ID NO: 1651 - RNA, 12 nt, Artificial Sequence
  source: /note="Description of Artificial Sequence: Synthetic oligonucleotide"
ugcuauuguacg

SEQ ID NO: 1652 - RNA, 12 nt, Artificial Sequence
  source: /note="Description of Artificial Sequence: Synthetic oligonucleotide"
gcuauuguacgu

SEQ ID NO: 1653 - RNA, 12 nt, Artificial Sequence
  source: /note="Description of Artificial Sequence: Synthetic oligonucleotide"
cuauuguacgua

SEQ ID NO: 1654 - RNA, 12 nt, Artificial Sequence
  source: /note="Description of Artificial Sequence: Synthetic oligonucleotide"
uuguacguacca

SEQ ID NO: 1655 - RNA, 12 nt, Artificial Sequence
  source: /note="Description of Artificial Sequence: Synthetic oligonucleotide"
uguacguaccau

SEQ ID NO: 1656 - RNA, 12 nt, Artificial Sequence
  source: /note="Description of Artificial Sequence: Synthetic oligonucleotide"
guacguaccaug

SEQ ID NO: 1657 - RNA, 12 nt, Artificial Sequence
  source: /note="Description of Artificial Sequence: Synthetic oligonucleotide"
uacguaccaugc

SEQ ID NO: 1658 - RNA, 12 nt, Artificial Sequence
  source: /note="Description of Artificial Sequence: Synthetic oligonucleotide"
acguaccaugca

SEQ ID NO: 1659 - RNA, 12 nt, Artificial Sequence
  source: /note="Description of Artificial Sequence: Synthetic oligonucleotide"
cguaccaugcag

SEQ ID NO: 1660 - RNA, 12 nt, Artificial Sequence
  source: /note="Description of Artificial Sequence: Synthetic oligonucleotide"
guaccaugcaga

SEQ ID NO: 1661 - RNA, 12 nt, Artificial Sequence
  source: /note="Description of Artificial Sequence: Synthetic oligonucleotide"
uaccaugcagaa

SEQ ID NO: 1662 - RNA, 12 nt, Artificial Sequence
  source: /note="Description of Artificial Sequence: Synthetic oligonucleotide"
accaugcagaau

SEQ ID NO: 1663 - RNA, 12 nt, Artificial Sequence
  source: /note="Description of Artificial Sequence: Synthetic oligonucleotide"
caugcagaauac

SEQ ID NO: 1664 - RNA, 12 nt, Artificial Sequence
  source: /note="Description of Artificial Sequence: Synthetic oligonucleotide"
augcagaauaca

SEQ ID NO: 1665 - RNA, 12 nt, Artificial Sequence
  source: /note="Description of Artificial Sequence: Synthetic oligonucleotide"
ugcagaauacaa

SEQ ID NO: 1666 - RNA, 12 nt, Artificial Sequence
  source: /note="Description of Artificial Sequence: Synthetic oligonucleotide"
gcagaauacaaa

SEQ ID NO: 1667 - RNA, 12 nt, Artificial Sequence
  source: /note="Description of Artificial Sequence: Synthetic oligonucleotide"
cagaauacaaau

SEQ ID NO: 1668 - RNA, 12 nt, Artificial Sequence
  source: /note="Description of Artificial Sequence: Synthetic oligonucleotide"
agaauacaaaug

SEQ ID NO: 1669 - RNA, 12 nt, Artificial Sequence
  source: /note="Description of Artificial Sequence: Synthetic oligonucleotide"
gaauacaaauga

SEQ ID NO: 1670 - RNA, 12 nt, Artificial Sequence
  source: /note="Description of Artificial Sequence: Synthetic oligonucleotide"
aauacaaaugau

SEQ ID NO: 1671 - RNA, 12 nt, Artificial Sequence
  source: /note="Description of Artificial Sequence: Synthetic oligonucleotide"
auacaaaugaug

SEQ ID NO: 1672 - RNA, 12 nt, Artificial Sequence
  source: /note="Description of Artificial Sequence: Synthetic oligonucleotide"
uacaaaugaugu

SEQ ID NO: 1673 - RNA, 12 nt, Artificial Sequence
  source: /note="Description of Artificial Sequence: Synthetic oligonucleotide"
acaaaugaugua

SEQ ID NO: 1674 - RNA, 12 nt, Artificial Sequence
  source: /note="Description of Artificial Sequence: Synthetic oligonucleotide"
caaaugauguag

SEQ ID NO: 1675 - RNA, 12 nt, Artificial Sequence
  source: /note="Description of Artificial Sequence: Synthetic oligonucleotide"
aaaugauguaga

SEQ ID NO: 1676 - RNA, 12 nt, Artificial Sequence
  source: /note="Description of Artificial Sequence: Synthetic oligonucleotide"
aaugauguagaa

SEQ ID NO: 1677 - RNA, 12 nt, Artificial Sequence
  source: /note="Description of Artificial Sequence: Synthetic oligonucleotide"
uaccgcugggac

SEQ ID NO: 1678 - RNA, 12 nt, Artificial Sequence
  source: /note="Description of Artificial Sequence: Synthetic oligonucleotide"
accgcugggacc

SEQ ID NO: 1679 - RNA, 12 nt, Artificial Sequence
  source: /note="Description of Artificial Sequence: Synthetic oligonucleotide"
ccgcugggaccu

SEQ ID NO: 1680 - RNA, 12 nt, Artificial Sequence
  source: /note="Description of Artificial Sequence: Synthetic oligonucleotide"
cgcugggaccuu

SEQ ID NO: 1681 - RNA, 12 nt, Artificial Sequence
  source: /note="Description of Artificial Sequence: Synthetic oligonucleotide"
gcugggaccuug

SEQ ID NO: 1682 - RNA, 12 nt, Artificial Sequence
  source: /note="Description of Artificial Sequence: Synthetic oligonucleotide"
cugggaccuugc

SEQ ID NO: 1683 - RNA, 12 nt, Artificial Sequence
  source: /note="Description of Artificial Sequence: Synthetic oligonucleotide"
ugggaccuugca

SEQ ID NO: 1684 - RNA, 12 nt, Artificial Sequence
  source: /note="Description of Artificial Sequence: Synthetic oligonucleotide"
gggaccuugcau

SEQ ID NO: 1685 - RNA, 12 nt, Artificial Sequence
  source: /note="Description of Artificial Sequence: Synthetic oligonucleotide"
ggaccuugcaua

SEQ ID NO: 1686 - RNA, 12 nt, Artificial Sequence
  source: /note="Description of Artificial Sequence: Synthetic oligonucleotide"
gaccuugcauaa

SEQ ID NO: 1687 - RNA, 12 nt, Artificial Sequence
  source: /note="Description of Artificial Sequence: Synthetic oligonucleotide"
accuugcauaac

SEQ ID NO: 1688 - RNA, 12 nt, Artificial Sequence
  source: /note="Description of Artificial Sequence: Synthetic oligonucleotide"
ccuugcauaacc

SEQ ID NO: 1689 - RNA, 12 nt, Artificial Sequence
  source: /note="Description of Artificial Sequence: Synthetic oligonucleotide"
cuugcauaaccu

SEQ ID NO: 1690 - RNA, 12 nt, Artificial Sequence
  source: /note="Description of Artificial Sequence: Synthetic oligonucleotide"
uugcauaaccuu

SEQ ID NO: 1691 - RNA, 12 nt, Artificial Sequence
  source: /note="Description of Artificial Sequence: Synthetic oligonucleotide"
ugcauaaccuuu

SEQ ID NO: 1692 - RNA, 12 nt, Artificial Sequence
  source: /note="Description of Artificial Sequence: Synthetic oligonucleotide"
gcauaaccuuuc

SEQ ID NO: 1693 - RNA, 12 nt, Artificial Sequence
  source: /note="Description of Artificial Sequence: Synthetic oligonucleotide"
cauaaccuuucc

SEQ ID NO: 1694 - RNA, 12 nt, Artificial Sequence
  source: /note="Description of Artificial Sequence: Synthetic oligonucleotide"
ucuuuaagucug

SEQ ID NO: 1695 - RNA, 12 nt, Artificial Sequence
  source: /note="Description of Artificial Sequence: Synthetic oligonucleotide"
cuuuaagucugg

SEQ ID NO: 1696 - RNA, 12 nt, Artificial Sequence
  source: /note="Description of Artificial Sequence: Synthetic oligonucleotide"
cauuccugcccu

SEQ ID NO: 1697 - RNA, 12 nt, Artificial Sequence
  source: /note="Description of Artificial Sequence: Synthetic oligonucleotide"
auuccugcccug

SEQ ID NO: 1698 - RNA, 12 nt, Artificial Sequence
  source: /note="Description of Artificial Sequence: Synthetic oligonucleotide"
uuccugcccugg

SEQ ID NO: 1699 - RNA, 12 nt, Artificial Sequence
  source: /note="Description of Artificial Sequence: Synthetic oligonucleotide"
uccugcccuggu

SEQ ID NO: 1700 - RNA, 12 nt, Artificial Sequence
  source: /note="Description of Artificial Sequence: Synthetic oligonucleotide"
ccugcccuggug

SEQ ID NO: 1701 - RNA, 12 nt, Artificial Sequence
  source: /note="Description of Artificial Sequence: Synthetic oligonucleotide"
cugcccugguga

SEQ ID NO: 1702 - RNA, 12 nt, Artificial Sequence
  source: /note="Description of Artificial Sequence: Synthetic oligonucleotide"
ugcccuggugaa

SEQ ID NO: 1703 - RNA, 12 nt, Artificial Sequence
  source: /note="Description of Artificial Sequence: Synthetic oligonucleotide"
gcccuggugaaa

SEQ ID NO: 1704 - RNA, 12 nt, Artificial Sequence
  source: /note="Description of Artificial Sequence: Synthetic oligonucleotide"
cccuggugaaaa

SEQ ID NO: 1705 - RNA, 12 nt, Artificial Sequence
  source: /note="Description of Artificial Sequence: Synthetic oligonucleotide"
ccuggugaaaau

SEQ ID NO: 1706 - RNA, 12 nt, Artificial Sequence
  source: /note="Description of Artificial Sequence: Synthetic oligonucleotide"
cuggugaaaaug

SEQ ID NO: 1707 - RNA, 12 nt, Artificial Sequence
  source: /note="Description of Artificial Sequence: Synthetic oligonucleotide"
uggugaaaaugc

SEQ ID NO: 1708 - RNA, 12 nt, Artificial Sequence
  source: /note="Description of Artificial Sequence: Synthetic oligonucleotide"
ggugaaaaugcu

SEQ ID NO: 1709 - RNA, 12 nt, Artificial Sequence
  source: /note="Description of Artificial Sequence: Synthetic oligonucleotide"
gugaaaaugcuu

SEQ ID NO: 1710 - RNA, 12 nt, Artificial Sequence
  source: /note="Description of Artificial Sequence: Synthetic oligonucleotide"
cuugguucacca

SEQ ID NO: 1711 - RNA, 12 nt, Artificial Sequence
  source: /note="Description of Artificial Sequence: Synthetic oligonucleotide"
uugguucaccag

SEQ ID NO: 1712 - RNA, 12 nt, Artificial Sequence
  source: /note="Description of Artificial Sequence: Synthetic oligonucleotide"
ugguucaccagu

SEQ ID NO: 1713 - RNA, 12 nt, Artificial Sequence
  source: /note="Description of Artificial Sequence: Synthetic oligonucleotide"
gguucaccagug

SEQ ID NO: 1714 - RNA, 12 nt, Artificial Sequence
  source: /note="Description of Artificial Sequence: Synthetic oligonucleotide"
guucaccagugg

SEQ ID NO: 1715 - RNA, 12 nt, Artificial Sequence
  source: /note="Description of Artificial Sequence: Synthetic oligonucleotide"
uucaccagugga

SEQ ID NO: 1716 - RNA, 12 nt, Artificial Sequence
  source: /note="Description of Artificial Sequence: Synthetic oligonucleotide"
ucaccaguggau

SEQ ID NO: 1717 - RNA, 12 nt, Artificial Sequence
  source: /note="Description of Artificial Sequence: Synthetic oligonucleotide"
caccaguggauu

SEQ ID NO: 1718 - RNA, 12 nt, Artificial Sequence
  source: /note="Description of Artificial Sequence: Synthetic oligonucleotide"
caguggauucug

SEQ ID NO: 1719 - RNA, 12 nt, Artificial Sequence
  source: /note="Description of Artificial Sequence: Synthetic oligonucleotide"
aguggauucugu

SEQ ID NO: 1720 - RNA, 12 nt, Artificial Sequence
  source: /note="Description of Artificial Sequence: Synthetic oligonucleotide"
guggauucugug

SEQ ID NO: 1721 - RNA, 12 nt, Artificial Sequence
  source: /note="Description of Artificial Sequence: Synthetic oligonucleotide"
uggauucugugu

SEQ ID NO: 1722 - RNA, 12 nt, Artificial Sequence
  source: /note="Description of Artificial Sequence: Synthetic oligonucleotide"
ggauucuguguu

SEQ ID NO: 1723 - RNA, 12 nt, Artificial Sequence
  source: /note="Description of Artificial Sequence: Synthetic oligonucleotide"
gauucuguguug

SEQ ID NO: 1724 - RNA, 12 nt, Artificial Sequence
  source: /note="Description of Artificial Sequence: Synthetic oligonucleotide"
auucuguguugu

SEQ ID NO: 1725 - RNA, 12 nt, Artificial Sequence
  source: /note="Description of Artificial Sequence: Synthetic oligonucleotide"
uucuguguuguu

SEQ ID NO: 1726 - RNA, 12 nt, Artificial Sequence
  source: /note="Description of Artificial Sequence: Synthetic oligonucleotide"
ucuguguuguuu

SEQ ID NO: 1727 - RNA, 12 nt, Artificial Sequence
  source: /note="Description of Artificial Sequence: Synthetic oligonucleotide"
cuguguuguuuu

SEQ ID NO: 1728 - RNA, 12 nt, Artificial Sequence
  source: /note="Description of Artificial Sequence: Synthetic oligonucleotide"
uguguuguuuua

SEQ ID NO: 1729 - RNA, 12 nt, Artificial Sequence
  source: /note="Description of Artificial Sequence: Synthetic oligonucleotide"
guguuguuuuau

SEQ ID NO: 1730 - RNA, 12 nt, Artificial Sequence
  source: /note="Description of Artificial Sequence: Synthetic oligonucleotide"
uguuguuuuaug

SEQ ID NO: 1731 - RNA, 12 nt, Artificial Sequence
  source: /note="Description of Artificial Sequence: Synthetic oligonucleotide"
guuguuuuaugc

SEQ ID NO: 1732 - RNA, 12 nt, Artificial Sequence
  source: /note="Description of Artificial Sequence: Synthetic oligonucleotide"
uuguuuuaugcc

SEQ ID NO: 1733 - RNA, 12 nt, Artificial Sequence
  source: /note="Description of Artificial Sequence: Synthetic oligonucleotide"
uguuuuaugcca

SEQ ID NO: 1734 - RNA, 12 nt, Artificial Sequence
  source: /note="Description of Artificial Sequence: Synthetic oligonucleotide"
guuuuaugccau

SEQ ID NO: 1735 - RNA, 12 nt, Artificial Sequence
  source: /note="Description of Artificial Sequence: Synthetic oligonucleotide"
uuuuaugccauu

SEQ ID NO: 1736 - RNA, 12 nt, Artificial Sequence
  source: /note="Description of Artificial Sequence: Synthetic oligonucleotide"
uuuaugccauua

SEQ ID NO: 1737 - RNA, 12 nt, Artificial Sequence
  source: /note="Description of Artificial Sequence: Synthetic oligonucleotide"
uaugccauuaca

SEQ ID NO: 1738 - RNA, 12 nt, Artificial Sequence
  source: /note="Description of Artificial Sequence: Synthetic oligonucleotide"
augccauuacaa

SEQ ID NO: 1739 - RNA, 12 nt, Artificial Sequence
  source: /note="Description of Artificial Sequence: Synthetic oligonucleotide"
ccauuacaacuc

SEQ ID NO: 1740 - RNA, 12 nt, Artificial Sequence
  source: /note="Description of Artificial Sequence: Synthetic oligonucleotide"
cauuacaacucu

SEQ ID NO: 1741 - RNA, 12 nt, Artificial Sequence
  source: /note="Description of Artificial Sequence: Synthetic oligonucleotide"
auuacaacucuc

SEQ ID NO: 1742 - RNA, 12 nt, Artificial Sequence
  source: /note="Description of Artificial Sequence: Synthetic oligonucleotide"
uuacaacucucc

SEQ ID NO: 1743 - RNA, 12 nt, Artificial Sequence
  source: /note="Description of Artificial Sequence: Synthetic oligonucleotide"
uacaacucucca

SEQ ID NO: 1744 - RNA, 12 nt, Artificial Sequence
  source: /note="Description of Artificial Sequence: Synthetic oligonucleotide"
acaacucuccac

SEQ ID NO: 1745 - RNA, 12 nt, Artificial Sequence
  source: /note="Description of Artificial Sequence: Synthetic oligonucleotide"
caacucuccaca

SEQ ID NO: 1746 - RNA, 12 nt, Artificial Sequence
  source: /note="Description of Artificial Sequence: Synthetic oligonucleotide"
aacucuccacaa

SEQ ID NO: 1747 - RNA, 12 nt, Artificial Sequence
  source: /note="Description of Artificial Sequence: Synthetic oligonucleotide"
acucuccacaac

SEQ ID NO: 1748 - RNA, 12 nt, Artificial Sequence
  source: /note="Description of Artificial Sequence: Synthetic oligonucleotide"
cucuccacaacc

SEQ ID NO: 1749 - RNA, 12 nt, Artificial Sequence
  source: /note="Description of Artificial Sequence: Synthetic oligonucleotide"
ucuccacaaccu

SEQ ID NO: 1750 - RNA, 12 nt, Artificial Sequence
  source: /note="Description of Artificial Sequence: Synthetic oligonucleotide"
cuccacaaccuu

SEQ ID NO: 1751 - RNA, 12 nt, Artificial Sequence
  source: /note="Description of Artificial Sequence: Synthetic oligonucleotide"
uccacaaccuuu

SEQ ID NO: 1752 - RNA, 12 nt, Artificial Sequence
  source: /note="Description of Artificial Sequence: Synthetic oligonucleotide"
ccacaaccuuuu

SEQ ID NO: 1753 - RNA, 12 nt, Artificial Sequence
  source: /note="Description of Artificial Sequence: Synthetic oligonucleotide"
cacaaccuuuua

SEQ ID NO: 1754 - RNA, 12 nt, Artificial Sequence
  source: /note="Description of Artificial Sequence: Synthetic oligonucleotide"
acaaccuuuuau

SEQ ID NO: 1755 - RNA, 12 nt, Artificial Sequence
  source: /note="Description of Artificial Sequence: Synthetic oligonucleotide"
caaccuuuuauu

SEQ ID NO: 1756 - RNA, 12 nt, Artificial Sequence
  source: /note="Description of Artificial Sequence: Synthetic oligonucleotide"
aaccuuuuauua

SEQ ID NO: 1757 - RNA, 12 nt, Artificial Sequence
  source: /note="Description of Artificial Sequence: Synthetic oligonucleotide"
ccuuuuauuaca

SEQ ID NO: 1758 - RNA, 12 nt, Artificial Sequence
  source: /note="Description of Artificial Sequence: Synthetic oligonucleotide"
cuuuuauuacau

SEQ ID NO: 1759 - RNA, 12 nt, Artificial Sequence
  source: /note="Description of Artificial Sequence: Synthetic oligonucleotide"
uuuuauuacauc

SEQ ID NO: 1760 - RNA, 12 nt, Artificial Sequence
  source: /note="Description of Artificial Sequence: Synthetic oligonucleotide"
uuuauuacauca

SEQ ID NO: 1761 - RNA, 12 nt, Artificial Sequence
  source: /note="Description of Artificial Sequence: Synthetic oligonucleotide"
uuauuacaucaa

SEQ ID NO: 1762 - RNA, 12 nt, Artificial Sequence
  source: /note="Description of Artificial Sequence: Synthetic oligonucleotide"
uuacaucaagaa

SEQ ID NO: 1763 - RNA, 12 nt, Artificial Sequence
  source: /note="Description of Artificial Sequence: Synthetic oligonucleotide"
uacaucaagaag

SEQ ID NO: 1764 - RNA, 12 nt, Artificial Sequence
  source: /note="Description of Artificial Sequence: Synthetic oligonucleotide"
acaucaagaagg

SEQ ID NO: 1765 - RNA, 12 nt, Artificial Sequence
  source: /note="Description of Artificial Sequence: Synthetic oligonucleotide"
caucaagaagga

SEQ ID NO: 1766 - RNA, 12 nt, Artificial Sequence
  source: /note="Description of Artificial Sequence: Synthetic oligonucleotide"
aucaagaaggag

SEQ ID NO: 1767 - RNA, 12 nt, Artificial Sequence
  source: /note="Description of Artificial Sequence: Synthetic oligonucleotide"
ucaagaaggagc

SEQ ID NO: 1768 - RNA, 12 nt, Artificial Sequence
  source: /note="Description of Artificial Sequence: Synthetic oligonucleotide"
caagaaggagcu

SEQ ID NO: 1769 - RNA, 12 nt, Artificial Sequence
  source: /note="Description of Artificial Sequence: Synthetic oligonucleotide"
aagaaggagcua

SEQ ID NO: 1770 - RNA, 12 nt, Artificial Sequence
  source: /note="Description of Artificial Sequence: Synthetic oligonucleotide"
agaaggagcuaa

SEQ ID NO: 1771 - RNA, 12 nt, Artificial Sequence
  source: /note="Description of Artificial Sequence: Synthetic oligonucleotide"
gaaggagcuaaa

SEQ ID NO: 1772 - RNA, 12 nt, Artificial Sequence
  source: /note="Description of Artificial Sequence: Synthetic oligonucleotide"
aaggagcuaaaa

SEQ ID NO: 1773 - RNA, 12 nt, Artificial Sequence
  source: /note="Description of Artificial Sequence: Synthetic oligonucleotide"
aggagcuaaaau

SEQ ID NO: 1774 - RNA, 12 nt, Artificial Sequence
  source: /note="Description of Artificial Sequence: Synthetic oligonucleotide"
gcuaaaauggca

SEQ ID NO: 1775 - RNA, 12 nt, Artificial Sequence
  source: /note="Description of Artificial Sequence: Synthetic oligonucleotide"
cuaaaauggcag

SEQ ID NO: 1776 - RNA, 12 nt, Artificial Sequence
  source: /note="Description of Artificial Sequence: Synthetic oligonucleotide"
uaaaauggcagu

SEQ ID NO: 1777 - RNA, 12 nt, Artificial Sequence
  source: /note="Description of Artificial Sequence: Synthetic oligonucleotide"
aaaauggcagug

SEQ ID NO: 1778 - RNA, 12 nt, Artificial Sequence
  source: /note="Description of Artificial Sequence: Synthetic oligonucleotide"
aaauggcagugc

SEQ ID NO: 1779 - RNA, 12 nt, Artificial Sequence
  source: /note="Description of Artificial Sequence: Synthetic oligonucleotide"
aauggcagugcg

SEQ ID NO: 1780 - RNA, 12 nt, Artificial Sequence
  source: /note="Description of Artificial Sequence: Synthetic oligonucleotide"
auggcagugcgu

SEQ ID NO: 1781 - RNA, 12 nt, Artificial Sequence
  source: /note="Description of Artificial Sequence: Synthetic oligonucleotide"
uggcagugcguu

SEQ ID NO: 1782 - RNA, 12 nt, Artificial Sequence
  source: /note="Description of Artificial Sequence: Synthetic oligonucleotide"
ugguugccuugc

SEQ ID NO: 1783 - RNA, 12 nt, Artificial Sequence
  source: /note="Description of Artificial Sequence: Synthetic oligonucleotide"
gguugccuugcu

SEQ ID NO: 1784 - RNA, 12 nt, Artificial Sequence
  source: /note="Description of Artificial Sequence: Synthetic oligonucleotide"
guugccuugcuc

SEQ ID NO: 1785 - RNA, 12 nt, Artificial Sequence
  source: /note="Description of Artificial Sequence: Synthetic oligonucleotide"
uugccuugcuca

SEQ ID NO: 1786 - RNA, 12 nt, Artificial Sequence
  source: /note="Description of Artificial Sequence: Synthetic oligonucleotide"
ugccuugcucaa

SEQ ID NO: 1787 - RNA, 12 nt, Artificial Sequence
  source: /note="Description of Artificial Sequence: Synthetic oligonucleotide"
gccuugcucaac

SEQ ID NO: 1788 - RNA, 12 nt, Artificial Sequence
  source: /note="Description of Artificial Sequence: Synthetic oligonucleotide"
ccuugcucaaca

SEQ ID NO: 1789 - RNA, 12 nt, Artificial Sequence
  source: /note="Description of Artificial Sequence: Synthetic oligonucleotide"
cuugcucaacaa

SEQ ID NO: 1790 - RNA, 12 nt, Artificial Sequence
  source: /note="Description of Artificial Sequence: Synthetic oligonucleotide"
uugcucaacaaa

SEQ ID NO: 1791 - RNA, 12 nt, Artificial Sequence
  source: /note="Description of Artificial Sequence: Synthetic oligonucleotide"
ugcucaacaaaa

SEQ ID NO: 1792 - RNA, 12 nt, Artificial Sequence
  source: /note="Description of Artificial Sequence: Synthetic oligonucleotide"
gcucaacaaaac

SEQ ID NO: 1793 - RNA, 12 nt, Artificial Sequence
  source: /note="Description of Artificial Sequence: Synthetic oligonucleotide"
cucaacaaaaca

SEQ ID NO: 1794 - RNA, 12 nt, Artificial Sequence
  source: /note="Description of Artificial Sequence: Synthetic oligonucleotide"
ucaacaaaacaa

SEQ ID NO: 1795 - RNA, 12 nt, Artificial Sequence
  source: /note="Description of Artificial Sequence: Synthetic oligonucleotide"
agugguggaccc

SEQ ID NO: 1796 - RNA, 12 nt, Artificial Sequence
  source: /note="Description of Artificial Sequence: Synthetic oligonucleotide"
gugguggacccc

SEQ ID NO: 1797 - RNA, 12 nt, Artificial Sequence
  source: /note="Description of Artificial Sequence: Synthetic oligonucleotide"
ugguggacccca

SEQ ID NO: 1798 - RNA, 12 nt, Artificial Sequence
  source: /note="Description of Artificial Sequence: Synthetic oligonucleotide"
gguggaccccaa

SEQ ID NO: 1799 - RNA, 12 nt, Artificial Sequence
  source: /note="Description of Artificial Sequence: Synthetic oligonucleotide"
guggaccccaag

SEQ ID NO: 1800 - RNA, 12 nt, Artificial Sequence
  source: /note="Description of Artificial Sequence: Synthetic oligonucleotide"
uggaccccaagc

SEQ ID NO: 1801 - RNA, 12 nt, Artificial Sequence
  source: /note="Description of Artificial Sequence: Synthetic oligonucleotide"
ggaccccaagcu

SEQ ID NO: 1802 - RNA, 12 nt, Artificial Sequence
  source: /note="Description of Artificial Sequence: Synthetic oligonucleotide"
gaccccaagcuu

SEQ ID NO: 1803 - RNA, 12 nt, Artificial Sequence
  source: /note="Description of Artificial Sequence: Synthetic oligonucleotide"
accccaagcuuu

SEQ ID NO: 1804 - RNA, 12 nt, Artificial Sequence
  source: /note="Description of Artificial Sequence: Synthetic oligonucleotide"
ccccaagcuuua

SEQ ID NO: 1805 - RNA, 12 nt, Artificial Sequence
  source: /note="Description of Artificial Sequence: Synthetic oligonucleotide"
cccaagcuuuag

SEQ ID NO: 1806 - RNA, 12 nt, Artificial Sequence
  source: /note="Description of Artificial Sequence: Synthetic oligonucleotide"
ccaagcuuuagu

SEQ ID NO: 1807 - RNA, 12 nt, Artificial Sequence
  source: /note="Description of Artificial Sequence: Synthetic oligonucleotide"
caagcuuuagua

SEQ ID NO: 1808 - RNA, 12 nt, Artificial Sequence
  source: /note="Description of Artificial Sequence: Synthetic oligonucleotide"
aagcuuuaguaa

SEQ ID NO: 1809 - RNA, 12 nt, Artificial Sequence
  source: /note="Description of Artificial Sequence: Synthetic oligonucleotide"
agcuuuaguaaa

SEQ ID NO: 1810 - RNA, 12 nt, Artificial Sequence
  source: /note="Description of Artificial Sequence: Synthetic oligonucleotide"
gcuuuaguaaau

SEQ ID NO: 1811 - RNA, 12 nt, Artificial Sequence
  source: /note="Description of Artificial Sequence: Synthetic oligonucleotide"
cuuuaguaaaua

SEQ ID NO: 1812 - RNA, 12 nt, Artificial Sequence
  source: /note="Description of Artificial Sequence: Synthetic oligonucleotide"
uuuaguaaauau

SEQ ID NO: 1813 - RNA, 12 nt, Artificial Sequence
  source: /note="Description of Artificial Sequence: Synthetic oligonucleotide"
uuaguaaauaua

SEQ ID NO: 1814 - RNA, 12 nt, Artificial Sequence
  source: /note="Description of Artificial Sequence: Synthetic oligonucleotide"
uaguaaauauaa

SEQ ID NO: 1815 - RNA, 12 nt, Artificial Sequence
  source: /note="Description of Artificial Sequence: Synthetic oligonucleotide"
aaauauaaugag

SEQ ID NO: 1816 - RNA, 12 nt, Artificial Sequence
  source: /note="Description of Artificial Sequence: Synthetic oligonucleotide"
aauauaaugagg

SEQ ID NO: 1817 - RNA, 12 nt, Artificial Sequence
  source: /note="Description of Artificial Sequence: Synthetic oligonucleotide"
auauaaugagga

SEQ ID NO: 1818 - RNA, 12 nt, Artificial Sequence
  source: /note="Description of Artificial Sequence: Synthetic oligonucleotide"
uauaaugaggac

SEQ ID NO: 1819 - RNA, 12 nt, Artificial Sequence
  source: /note="Description of Artificial Sequence: Synthetic oligonucleotide"
auaaugaggacc

SEQ ID NO: 1820 - RNA, 12 nt, Artificial Sequence
  source: /note="Description of Artificial Sequence: Synthetic oligonucleotide"
uaaugaggaccu

SEQ ID NO: 1821 - RNA, 12 nt, Artificial Sequence
  source: /note="Description of Artificial Sequence: Synthetic oligonucleotide"
aaugaggaccua

SEQ ID NO: 1822 - RNA, 12 nt, Artificial Sequence
  source: /note="Description of Artificial Sequence: Synthetic oligonucleotide"
augaggaccuau

SEQ ID NO: 1823 - RNA, 12 nt, Artificial Sequence
  source: /note="Description of Artificial Sequence: Synthetic oligonucleotide"
ugaggaccuaua

SEQ ID NO: 1824 - RNA, 12 nt, Artificial Sequence
  source: /note="Description of Artificial Sequence: Synthetic oligonucleotide"
acaagcagagug

SEQ ID NO: 1825 - RNA, 12 nt, Artificial Sequence
  source: /note="Description of Artificial Sequence: Synthetic oligonucleotide"
caagcagagugc

SEQ ID NO: 1826 - RNA, 12 nt, Artificial Sequence
  source: /note="Description of Artificial Sequence: Synthetic oligonucleotide"
aagcagagugcu

SEQ ID NO: 1827 - RNA, 12 nt, Artificial Sequence
  source: /note="Description of Artificial Sequence: Synthetic oligonucleotide"
agcagagugcug

SEQ ID NO: 1828 - RNA, 12 nt, Artificial Sequence
  source: /note="Description of Artificial Sequence: Synthetic oligonucleotide"
gcagagugcuga

SEQ ID NO: 1829 - RNA, 12 nt, Artificial Sequence
  source: /note="Description of Artificial Sequence: Synthetic oligonucleotide"
cagagugcugaa

SEQ ID NO: 1830 - RNA, 12 nt, Artificial Sequence
  source: /note="Description of Artificial Sequence: Synthetic oligonucleotide"
agagugcugaag

SEQ ID NO: 1831 - RNA, 12 nt, Artificial Sequence
  source: /note="Description of Artificial Sequence: Synthetic oligonucleotide"
gagugcugaagg

SEQ ID NO: 1832 - RNA, 12 nt, Artificial Sequence
  source: /note="Description of Artificial Sequence: Synthetic oligonucleotide"
agugcugaaggu

SEQ ID NO: 1833 - RNA, 12 nt, Artificial Sequence
  source: /note="Description of Artificial Sequence: Synthetic oligonucleotide"
gugcugaaggug

SEQ ID NO: 1834 - RNA, 12 nt, Artificial Sequence
  source: /note="Description of Artificial Sequence: Synthetic oligonucleotide"
ugcugaaggugc

SEQ ID NO: 1835 - RNA, 12 nt, Artificial Sequence
  source: /note="Description of Artificial Sequence: Synthetic oligonucleotide"
gcugaaggugcu

SEQ ID NO: 1836 - RNA, 12 nt, Artificial Sequence
  source: /note="Description of Artificial Sequence: Synthetic oligonucleotide"
cugaaggugcua

SEQ ID NO: 1837 - RNA, 12 nt, Artificial Sequence
  source: /note="Description of Artificial Sequence: Synthetic oligonucleotide"
ucugcucuagua

SEQ ID NO: 1838 - RNA, 12 nt, Artificial Sequence
  source: /note="Description of Artificial Sequence: Synthetic oligonucleotide"
cugcucuaguaa

SEQ ID NO: 1839 - RNA, 12 nt, Artificial Sequence
  source: /note="Description of Artificial Sequence: Synthetic oligonucleotide"
ugcucuaguaau

SEQ ID NO: 1840 - RNA, 12 nt, Artificial Sequence
  source: /note="Description of Artificial Sequence: Synthetic oligonucleotide"
gcucuaguaaua

SEQ ID NO: 1841 - RNA, 12 nt, Artificial Sequence
  source: /note="Description of Artificial Sequence: Synthetic oligonucleotide"
cucuaguaauaa

SEQ ID NO: 1842 - RNA, 12 nt, Artificial Sequence
  source: /note="Description of Artificial Sequence: Synthetic oligonucleotide"
ucuaguaauaag

SEQ ID NO: 1843 - RNA, 12 nt, Artificial Sequence
  source: /note="Description of Artificial Sequence: Synthetic oligonucleotide"
cuaguaauaagc

SEQ ID NO: 1844 - RNA, 12 nt, Artificial Sequence
  source: /note="Description of Artificial Sequence: Synthetic oligonucleotide"
uuguagaagcug

SEQ ID NO: 1845 - RNA, 12 nt, Artificial Sequence
  source: /note="Description of Artificial Sequence: Synthetic oligonucleotide"
uguagaagcugg

SEQ ID NO: 1846 - RNA, 12 nt, Artificial Sequence
  source: /note="Description of Artificial Sequence: Synthetic oligonucleotide"
guagaagcuggu

SEQ ID NO: 1847 - RNA, 12 nt, Artificial Sequence
  source: /note="Description of Artificial Sequence: Synthetic oligonucleotide"
uagaagcuggug

SEQ ID NO: 1848 - RNA, 12 nt, Artificial Sequence
  source: /note="Description of Artificial Sequence: Synthetic oligonucleotide"
agaagcuggugg

SEQ ID NO: 1849 - RNA, 12 nt, Artificial Sequence
  source: /note="Description of Artificial Sequence: Synthetic oligonucleotide"
gaagcuggugga

SEQ ID NO: 1850 - RNA, 12 nt, Artificial Sequence
  source: /note="Description of Artificial Sequence: Synthetic oligonucleotide"
aagcugguggaa

SEQ ID NO: 1851 - RNA, 12 nt, Artificial Sequence
  source: /note="Description of Artificial Sequence: Synthetic oligonucleotide"
cugguggaaugc

SEQ ID NO: 1852 - RNA, 12 nt, Artificial Sequence
  source: /note="Description of Artificial Sequence: Synthetic oligonucleotide"
ugguggaaugca

SEQ ID NO: 1853 - RNA, 12 nt, Artificial Sequence
  source: /note="Description of Artificial Sequence: Synthetic oligonucleotide"
gguggaaugcaa

SEQ ID NO: 1854 - RNA, 12 nt, Artificial Sequence
  source: /note="Description of Artificial Sequence: Synthetic oligonucleotide"
guggaaugcaag

SEQ ID NO: 1855 - RNA, 12 nt, Artificial Sequence
  source: /note="Description of Artificial Sequence: Synthetic oligonucleotide"
uggaaugcaagc

SEQ ID NO: 1856 - RNA, 12 nt, Artificial Sequence
  source: /note="Description of Artificial Sequence: Synthetic oligonucleotide"
ggaaugcaagcu

SEQ ID NO: 1857 - RNA, 12 nt, Artificial Sequence
  source: /note="Description of Artificial Sequence: Synthetic oligonucleotide"
gaaugcaagcuu

SEQ ID NO: 1858 - RNA, 12 nt, Artificial Sequence
  source: /note="Description of Artificial Sequence: Synthetic oligonucleotide"
cuucaccugaca

SEQ ID NO: 1859 - RNA, 12 nt, Artificial Sequence
  source: /note="Description of Artificial Sequence: Synthetic oligonucleotide"
uucaccugacag

SEQ ID NO: 1860 - RNA, 12 nt, Artificial Sequence
  source: /note="Description of Artificial Sequence: Synthetic oligonucleotide"
ucaccugacaga

SEQ ID NO: 1861 - RNA, 12 nt, Artificial Sequence
  source: /note="Description of Artificial Sequence: Synthetic oligonucleotide"
caccugacagau

SEQ ID NO: 1862 - RNA, 12 nt, Artificial Sequence
  source: /note="Description of Artificial Sequence: Synthetic oligonucleotide"
ccugacagaucc

SEQ ID NO: 1863 - RNA, 12 nt, Artificial Sequence
  source: /note="Description of Artificial Sequence: Synthetic oligonucleotide"
cugacagaucca

SEQ ID NO: 1864 - RNA, 12 nt, Artificial Sequence
  source: /note="Description of Artificial Sequence: Synthetic oligonucleotide"
ugacagauccaa

SEQ ID NO: 1865 - RNA, 12 nt, Artificial Sequence
  source: /note="Description of Artificial Sequence: Synthetic oligonucleotide"
agauccaaguca

SEQ ID NO: 1866 - RNA, 12 nt, Artificial Sequence
  source: /note="Description of Artificial Sequence: Synthetic oligonucleotide"
gauccaagucaa

SEQ ID NO: 1867 - RNA, 12 nt, Artificial Sequence
  source: /note="Description of Artificial Sequence: Synthetic oligonucleotide"
uccaagucaacg

SEQ ID NO: 1868 - RNA, 12 nt, Artificial Sequence
  source: /note="Description of Artificial Sequence: Synthetic oligonucleotide"
ccaagucaacgu

SEQ ID NO: 1869 - RNA, 12 nt, Artificial Sequence
  source: /note="Description of Artificial Sequence: Synthetic oligonucleotide"
caagucaacguc

SEQ ID NO: 1870 - RNA, 12 nt, Artificial Sequence
  source: /note="Description of Artificial Sequence: Synthetic oligonucleotide"
aagucaacgucu

SEQ ID NO: 1871 - RNA, 12 nt, Artificial Sequence
  source: /note="Description of Artificial Sequence: Synthetic oligonucleotide"
agucaacgucuu

SEQ ID NO: 1872 - RNA, 12 nt, Artificial Sequence
  source: /note="Description of Artificial Sequence: Synthetic oligonucleotide"
cuuguucagaac

SEQ ID NO: 1873 - RNA, 12 nt, Artificial Sequence
  source: /note="Description of Artificial Sequence: Synthetic oligonucleotide"
uuguucagaacu

SEQ ID NO: 1874 - RNA, 12 nt, Artificial Sequence
  source: /note="Description of Artificial Sequence: Synthetic oligonucleotide"
uguucagaacug

SEQ ID NO: 1875 - RNA, 12 nt, Artificial Sequence
  source: /note="Description of Artificial Sequence: Synthetic oligonucleotide"
guucagaacugu

SEQ ID NO: 1876 - RNA, 12 nt, Artificial Sequence
  source: /note="Description of Artificial Sequence: Synthetic oligonucleotide"
uucagaacuguc

SEQ ID NO: 1877 - RNA, 12 nt, Artificial Sequence
  source: /note="Description of Artificial Sequence: Synthetic oligonucleotide"
ucagaacugucu

SEQ ID NO: 1878 - RNA, 12 nt, Artificial Sequence
  source: /note="Description of Artificial Sequence: Synthetic oligonucleotide"
cagaacugucuu

SEQ ID NO: 1879 - RNA, 12 nt, Artificial Sequence
  source: /note="Description of Artificial Sequence: Synthetic oligonucleotide"
acugucuuugga

SEQ ID NO: 1880 - RNA, 12 nt, Artificial Sequence
  source: /note="Description of Artificial Sequence: Synthetic oligonucleotide"
cugucuuuggac

SEQ ID NO: 1881 - RNA, 12 nt, Artificial Sequence
  source: /note="Description of Artificial Sequence: Synthetic oligonucleotide"
ugucuuuggacu

SEQ ID NO: 1882 - RNA, 12 nt, Artificial Sequence
  source: /note="Description of Artificial Sequence: Synthetic oligonucleotide"
gucuuuggacuc

SEQ ID NO: 1883 - RNA, 12 nt, Artificial Sequence
  source: /note="Description of Artificial Sequence: Synthetic oligonucleotide"
ucuuuggacucu

SEQ ID NO: 1884 - RNA, 12 nt, Artificial Sequence
  source: /note="Description of Artificial Sequence: Synthetic oligonucleotide"
cuuuggacucuc

SEQ ID NO: 1885 - RNA, 12 nt, Artificial Sequence
  source: /note="Description of Artificial Sequence: Synthetic oligonucleotide"
uuuggacucuca

SEQ ID NO: 1886 - RNA, 12 nt, Artificial Sequence
  source: /note="Description of Artificial Sequence: Synthetic oligonucleotide"
uuggacucucag

SEQ ID NO: 1887 - RNA, 12 nt, Artificial Sequence
  source: /note="Description of Artificial Sequence: Synthetic oligonucleotide"
uggacucucagg

SEQ ID NO: 1888 - RNA, 12 nt, Artificial Sequence
  source: /note="Description of Artificial Sequence: Synthetic oligonucleotide"
ggacucucagga

SEQ ID NO: 1889 - RNA, 12 nt, Artificial Sequence
  source: /note="Description of Artificial Sequence: Synthetic oligonucleotide"
gacucucaggaa

SEQ ID NO: 1890 - RNA, 12 nt, Artificial Sequence
  source: /note="Description of Artificial Sequence: Synthetic oligonucleotide"
acucucaggaau

SEQ ID NO: 1891 - RNA, 12 nt, Artificial Sequence
  source: /note="Description of Artificial Sequence: Synthetic oligonucleotide"
cucucaggaauc

SEQ ID NO: 1892 - RNA, 12 nt, Artificial Sequence
  source: /note="Description of Artificial Sequence: Synthetic oligonucleotide"
ucucaggaaucu

SEQ ID NO: 1893 - RNA, 12 nt, Artificial Sequence
  source: /note="Description of Artificial Sequence: Synthetic oligonucleotide"
cucaggaaucuu

SEQ ID NO: 1894 - RNA, 12 nt, Artificial Sequence
  source: /note="Description of Artificial Sequence: Synthetic oligonucleotide"
ucaggaaucuuu

SEQ ID NO: 1895 - RNA, 12 nt, Artificial Sequence
  source: /note="Description of Artificial Sequence: Synthetic oligonucleotide"
aaucuuucagau

SEQ ID NO: 1896 - RNA, 12 nt, Artificial Sequence
  source: /note="Description of Artificial Sequence: Synthetic oligonucleotide"
cuuucagaugcu

SEQ ID NO: 1897 - RNA, 12 nt, Artificial Sequence
  source: /note="Description of Artificial Sequence: Synthetic oligonucleotide"
uuucagaugcug

SEQ ID NO: 1898 - RNA, 12 nt, Artificial Sequence
  source: /note="Description of Artificial Sequence: Synthetic oligonucleotide"
uucagaugcugc

SEQ ID NO: 1899 - RNA, 12 nt, Artificial Sequence
  source: /note="Description of Artificial Sequence: Synthetic oligonucleotide"
ucagaugcugca

SEQ ID NO: 1900 - RNA, 12 nt, Artificial Sequence
  source: /note="Description of Artificial Sequence: Synthetic oligonucleotide"
cagaugcugcaa

SEQ ID NO: 1901 - RNA, 12 nt, Artificial Sequence
  source: /note="Description of Artificial Sequence: Synthetic oligonucleotide"
agaugcugcaac

SEQ ID NO: 1902 - RNA, 12 nt, Artificial Sequence
  source: /note="Description of Artificial Sequence: Synthetic oligonucleotide"
gaugcugcaacu

SEQ ID NO: 1903 - RNA, 12 nt, Artificial Sequence
  source: /note="Description of Artificial Sequence: Synthetic oligonucleotide"
augcugcaacua

SEQ ID NO: 1904 - RNA, 12 nt, Artificial Sequence
  source: /note="Description of Artificial Sequence: Synthetic oligonucleotide"
ugcugcaacuaa

SEQ ID NO: 1905 - RNA, 12 nt, Artificial Sequence
  source: /note="Description of Artificial Sequence: Synthetic oligonucleotide"
gcugcaacuaaa

SEQ ID NO: 1906 - RNA, 12 nt, Artificial Sequence
  source: /note="Description of Artificial Sequence: Synthetic oligonucleotide"
ucuccuugggac

SEQ ID NO: 1907 - RNA, 12 nt, Artificial Sequence
  source: /note="Description of Artificial Sequence: Synthetic oligonucleotide"
cuccuugggacu

SEQ ID NO: 1908 - RNA, 12 nt, Artificial Sequence
  source: /note="Description of Artificial Sequence: Synthetic oligonucleotide"
uccuugggacuc

SEQ ID NO: 1909 - RNA, 12 nt, Artificial Sequence
  source: /note="Description of Artificial Sequence: Synthetic oligonucleotide"
ccuugggacucu

SEQ ID NO: 1910 - RNA, 12 nt, Artificial Sequence
  source: /note="Description of Artificial Sequence: Synthetic oligonucleotide"
cuugggacucuu

SEQ ID NO: 1911 - RNA, 12 nt, Artificial Sequence
  source: /note="Description of Artificial Sequence: Synthetic oligonucleotide"
ugggacucuugu

SEQ ID NO: 1912 - RNA, 12 nt, Artificial Sequence
  source: /note="Description of Artificial Sequence: Synthetic oligonucleotide"
gggacucuuguu

SEQ ID NO: 1913 - RNA, 12 nt, Artificial Sequence
  source: /note="Description of Artificial Sequence: Synthetic oligonucleotide"
cuuguucagcuu

SEQ ID NO: 1914 - RNA, 12 nt, Artificial Sequence
  source: /note="Description of Artificial Sequence: Synthetic oligonucleotide"
ucagcuucuggg

SEQ ID NO: 1915 - RNA, 12 nt, Artificial Sequence
  source: /note="Description of Artificial Sequence: Synthetic oligonucleotide"
cagcuucugggu

SEQ ID NO: 1916 - RNA, 12 nt, Artificial Sequence
  source: /note="Description of Artificial Sequence: Synthetic oligonucleotide"
agcuucuggguu

SEQ ID NO: 1917 - RNA, 12 nt, Artificial Sequence
  source: /note="Description of Artificial Sequence: Synthetic oligonucleotide"
gcuucuggguuc

SEQ ID NO: 1918 - RNA, 12 nt, Artificial Sequence
  source: /note="Description of Artificial Sequence: Synthetic oligonucleotide"
cuucuggguuca

SEQ ID NO: 1919 - RNA, 12 nt, Artificial Sequence
  source: /note="Description of Artificial Sequence: Synthetic oligonucleotide"
uucuggguucag

SEQ ID NO: 1920 - RNA, 12 nt, Artificial Sequence
  source: /note="Description of Artificial Sequence: Synthetic oligonucleotide"
ucuggguucaga

SEQ ID NO: 1921 - RNA, 12 nt, Artificial Sequence
  source: /note="Description of Artificial Sequence: Synthetic oligonucleotide"
cuggguucagau

SEQ ID NO: 1922 - RNA, 12 nt, Artificial Sequence
  source: /note="Description of Artificial Sequence: Synthetic oligonucleotide"
uggguucagaug

SEQ ID NO: 1923 - RNA, 12 nt, Artificial Sequence
  source: /note="Description of Artificial Sequence: Synthetic oligonucleotide"
ggguucagauga

SEQ ID NO: 1924 - RNA, 12 nt, Artificial Sequence
  source: /note="Description of Artificial Sequence: Synthetic oligonucleotide"
gguucagaugau

SEQ ID NO: 1925 - RNA, 12 nt, Artificial Sequence
  source: /note="Description of Artificial Sequence: Synthetic oligonucleotide"
guucagaugaua

SEQ ID NO: 1926 - RNA, 12 nt, Artificial Sequence
  source: /note="Description of Artificial Sequence: Synthetic oligonucleotide"
uucagaugauau

SEQ ID NO: 1927 - RNA, 12 nt, Artificial Sequence
  source: /note="Description of Artificial Sequence: Synthetic oligonucleotide"
ucagaugauaua

SEQ ID NO: 1928 - RNA, 12 nt, Artificial Sequence
  source: /note="Description of Artificial Sequence: Synthetic oligonucleotide"
cagaugauauaa

SEQ ID NO: 1929 - RNA, 12 nt, Artificial Sequence
  source: /note="Description of Artificial Sequence: Synthetic oligonucleotide"
ugauauaaaugu

SEQ ID NO: 1930 - RNA, 12 nt, Artificial Sequence
  source: /note="Description of Artificial Sequence: Synthetic oligonucleotide"
gauauaaaugug

SEQ ID NO: 1931 - RNA, 12 nt, Artificial Sequence
  source: /note="Description of Artificial Sequence: Synthetic oligonucleotide"
auauaaaugugg

SEQ ID NO: 1932 - RNA, 12 nt, Artificial Sequence
  source: /note="Description of Artificial Sequence: Synthetic oligonucleotide"
uauaaauguggu

SEQ ID NO: 1933 - RNA, 12 nt, Artificial Sequence
  source: /note="Description of Artificial Sequence: Synthetic oligonucleotide"
auaaaugugguc

SEQ ID NO: 1934 - RNA, 12 nt, Artificial Sequence
  source: /note="Description of Artificial Sequence: Synthetic oligonucleotide"
uaaaugugguca

SEQ ID NO: 1935 - RNA, 12 nt, Artificial Sequence
  source: /note="Description of Artificial Sequence: Synthetic oligonucleotide"
aaauguggucac

SEQ ID NO: 1936 - RNA, 12 nt, Artificial Sequence
  source: /note="Description of Artificial Sequence: Synthetic oligonucleotide"
aauguggucacc

SEQ ID NO: 1937 - RNA, 12 nt, Artificial Sequence
  source: /note="Description of Artificial Sequence: Synthetic oligonucleotide"
ucaccugugcag

SEQ ID NO: 1938 - RNA, 12 nt, Artificial Sequence
  source: /note="Description of Artificial Sequence: Synthetic oligonucleotide"
caccugugcagc

SEQ ID NO: 1939 - RNA, 12 nt, Artificial Sequence
  source: /note="Description of Artificial Sequence: Synthetic oligonucleotide"
accugugcagcu

SEQ ID NO: 1940 - RNA, 12 nt, Artificial Sequence
  source: /note="Description of Artificial Sequence: Synthetic oligonucleotide"
ccugugcagcug

SEQ ID NO: 1941 - RNA, 12 nt, Artificial Sequence
  source: /note="Description of Artificial Sequence: Synthetic oligonucleotide"
cugugcagcugg

SEQ ID NO: 1942 - RNA, 12 nt, Artificial Sequence
  source: /note="Description of Artificial Sequence: Synthetic oligonucleotide"
ugugcagcugga

SEQ ID NO: 1943 - RNA, 12 nt, Artificial Sequence
  source: /note="Description of Artificial Sequence: Synthetic oligonucleotide"
gugcagcuggaa

SEQ ID NO: 1944 - RNA, 12 nt, Artificial Sequence
  source: /note="Description of Artificial Sequence: Synthetic oligonucleotide"
ugcagcuggaau

SEQ ID NO: 1945 - RNA, 12 nt, Artificial Sequence
  source: /note="Description of Artificial Sequence: Synthetic oligonucleotide"
gcagcuggaauu

SEQ ID NO: 1946 - RNA, 12 nt, Artificial Sequence
  source: /note="Description of Artificial Sequence: Synthetic oligonucleotide"
cagcuggaauuc

SEQ ID NO: 1947 - RNA, 12 nt, Artificial Sequence
  source: /note="Description of Artificial Sequence: Synthetic oligonucleotide"
agcuggaauucu

SEQ ID NO: 1948 - RNA, 12 nt, Artificial Sequence
  source: /note="Description of Artificial Sequence: Synthetic oligonucleotide"
gcuggaauucuu

SEQ ID NO: 1949 - RNA, 12 nt, Artificial Sequence
  source: /note="Description of Artificial Sequence: Synthetic oligonucleotide"
cuggaauucuuu

SEQ ID NO: 1950 - RNA, 12 nt, Artificial Sequence
  source: /note="Description of Artificial Sequence: Synthetic oligonucleotide"
uggaauucuuuc

SEQ ID NO: 1951 - RNA, 12 nt, Artificial Sequence
  source: /note="Description of Artificial Sequence: Synthetic oligonucleotide"
ggaauucuuucu

SEQ ID NO: 1952 - RNA, 12 nt, Artificial Sequence
  source: /note="Description of Artificial Sequence: Synthetic oligonucleotide"
gaauucuuucua

SEQ ID NO: 1953 - RNA, 12 nt, Artificial Sequence
  source: /note="Description of Artificial Sequence: Synthetic oligonucleotide"
uuucuaaccuca

SEQ ID NO: 1954 - RNA, 12 nt, Artificial Sequence
  source: /note="Description of Artificial Sequence: Synthetic oligonucleotide"
uucuaaccucac

SEQ ID NO: 1955 - RNA, 12 nt, Artificial Sequence
  source: /note="Description of Artificial Sequence: Synthetic oligonucleotide"
ucuaaccucacu

SEQ ID NO: 1956 - RNA, 12 nt, Artificial Sequence
  source: /note="Description of Artificial Sequence: Synthetic oligonucleotide"
cuaaccucacuu

SEQ ID NO: 1957 - RNA, 12 nt, Artificial Sequence
  source: /note="Description of Artificial Sequence: Synthetic oligonucleotide"
uaaccucacuug

SEQ ID NO: 1958 - RNA, 12 nt, Artificial Sequence
  source: /note="Description of Artificial Sequence: Synthetic oligonucleotide"
aaccucacuugc

SEQ ID NO: 1959 - RNA, 12 nt, Artificial Sequence
  source: /note="Description of Artificial Sequence: Synthetic oligonucleotide"
accucacuugca

SEQ ID NO: 1960 - RNA, 12 nt, Artificial Sequence
  source: /note="Description of Artificial Sequence: Synthetic oligonucleotide"
ccucacuugcaa

SEQ ID NO: 1961 - RNA, 12 nt, Artificial Sequence
  source: /note="Description of Artificial Sequence: Synthetic oligonucleotide"
cucacuugcaau

SEQ ID NO: 1962 - RNA, 12 nt, Artificial Sequence
  source: /note="Description of Artificial Sequence: Synthetic oligonucleotide"
ucacuugcaaua

SEQ ID NO: 1963 - RNA, 12 nt, Artificial Sequence
  source: /note="Description of Artificial Sequence: Synthetic oligonucleotide"
cacuugcaauaa

SEQ ID NO: 1964 - RNA, 12 nt, Artificial Sequence
  source: /note="Description of Artificial Sequence: Synthetic oligonucleotide"
acuugcaauaau

SEQ ID NO: 1965 - RNA, 12 nt, Artificial Sequence
  source: /note="Description of Artificial Sequence: Synthetic oligonucleotide"
cuugcaauaauu

SEQ ID NO: 1966 - RNA, 12 nt, Artificial Sequence
  source: /note="Description of Artificial Sequence: Synthetic oligonucleotide"
uugcaauaauua

SEQ ID NO: 1967 - RNA, 12 nt, Artificial Sequence
  source: /note="Description of Artificial Sequence: Synthetic oligonucleotide"
ugcaauaauuau

SEQ ID NO: 1968 - RNA, 12 nt, Artificial Sequence
  source: /note="Description of Artificial Sequence: Synthetic oligonucleotide"
gcaauaauuaua

SEQ ID NO: 1969 - RNA, 12 nt, Artificial Sequence
  source: /note="Description of Artificial Sequence: Synthetic oligonucleotide"
caauaauuauaa

SEQ ID NO: 1970 - RNA, 12 nt, Artificial Sequence
  source: /note="Description of Artificial Sequence: Synthetic oligonucleotide"
ucugccaagugg

SEQ ID NO: 1971 - RNA, 12 nt, Artificial Sequence
  source: /note="Description of Artificial Sequence: Synthetic oligonucleotide"
cugccaaguggg

SEQ ID NO: 1972 - RNA, 12 nt, Artificial Sequence
  source: /note="Description of Artificial Sequence: Synthetic oligonucleotide"
ugccaagugggu

SEQ ID NO: 1973 - RNA, 12 nt, Artificial Sequence
  source: /note="Description of Artificial Sequence: Synthetic oligonucleotide"
gccaagugggug

SEQ ID NO: 1974 - RNA, 12 nt, Artificial Sequence
  source: /note="Description of Artificial Sequence: Synthetic oligonucleotide"
ccaagugggugg

SEQ ID NO: 1975 - RNA, 12 nt, Artificial Sequence
  source: /note="Description of Artificial Sequence: Synthetic oligonucleotide"
caaguggguggu

SEQ ID NO: 1976 - RNA, 12 nt, Artificial Sequence
  source: /note="Description of Artificial Sequence: Synthetic oligonucleotide"
aaguggguggua

SEQ ID NO: 1977 - RNA, 12 nt, Artificial Sequence
  source: /note="Description of Artificial Sequence: Synthetic oligonucleotide"
auagaggcucuu

SEQ ID NO: 1978 - RNA, 12 nt, Artificial Sequence
  source: /note="Description of Artificial Sequence: Synthetic oligonucleotide"
cuggugacaggg

SEQ ID NO: 1979 - RNA, 12 nt, Artificial Sequence
  source: /note="Description of Artificial Sequence: Synthetic oligonucleotide"
uggugacaggga

SEQ ID NO: 1980 - RNA, 12 nt, Artificial Sequence
  source: /note="Description of Artificial Sequence: Synthetic oligonucleotide"
ggugacagggaa

SEQ ID NO: 1981 - RNA, 12 nt, Artificial Sequence
  source: /note="Description of Artificial Sequence: Synthetic oligonucleotide"
gggaagacauca

SEQ ID NO: 1982 - RNA, 12 nt, Artificial Sequence
  source: /note="Description of Artificial Sequence: Synthetic oligonucleotide"
ggaagacaucac

SEQ ID NO: 1983 - RNA, 12 nt, Artificial Sequence
  source: /note="Description of Artificial Sequence: Synthetic oligonucleotide"
gaagacaucacu

SEQ ID NO: 1984 - RNA, 12 nt, Artificial Sequence
  source: /note="Description of Artificial Sequence: Synthetic oligonucleotide"
aagacaucacug

SEQ ID NO: 1985 - RNA, 12 nt, Artificial Sequence
  source: /note="Description of Artificial Sequence: Synthetic oligonucleotide"
agacaucacuga

SEQ ID NO: 1986 - RNA, 12 nt, Artificial Sequence
  source: /note="Description of Artificial Sequence: Synthetic oligonucleotide"
gacaucacugag

SEQ ID NO: 1987 - RNA, 12 nt, Artificial Sequence
  source: /note="Description of Artificial Sequence: Synthetic oligonucleotide"
acaucacugagc

SEQ ID NO: 1988 - RNA, 12 nt, Artificial Sequence
  source: /note="Description of Artificial Sequence: Synthetic oligonucleotide"
caucacugagcc

SEQ ID NO: 1989 - RNA, 12 nt, Artificial Sequence
  source: /note="Description of Artificial Sequence: Synthetic oligonucleotide"
aucacugagccu

SEQ ID NO: 1990 - RNA, 12 nt, Artificial Sequence
  source: /note="Description of Artificial Sequence: Synthetic oligonucleotide"
ccugccaucugu

SEQ ID NO: 1991 - RNA, 12 nt, Artificial Sequence
  source: /note="Description of Artificial Sequence: Synthetic oligonucleotide"
cugccaucugug

SEQ ID NO: 1992 - RNA, 12 nt, Artificial Sequence
  source: /note="Description of Artificial Sequence: Synthetic oligonucleotide"
ugccaucugugc

SEQ ID NO: 1993 - RNA, 12 nt, Artificial Sequence
  source: /note="Description of Artificial Sequence: Synthetic oligonucleotide"
gccaucugugcu

SEQ ID NO: 1994 - RNA, 12 nt, Artificial Sequence
  source: /note="Description of Artificial Sequence: Synthetic oligonucleotide"
ccaucugugcuc

SEQ ID NO: 1995 - RNA, 12 nt, Artificial Sequence
  source: /note="Description of Artificial Sequence: Synthetic oligonucleotide"
caucugugcucu

SEQ ID NO: 1996 - RNA, 12 nt, Artificial Sequence
  source: /note="Description of Artificial Sequence: Synthetic oligonucleotide"
aucugugcucuu

SEQ ID NO: 1997 - RNA, 12 nt, Artificial Sequence
  source: /note="Description of Artificial Sequence: Synthetic oligonucleotide"
ucugugcucuuc

SEQ ID NO: 1998 - RNA, 12 nt, Artificial Sequence
  source: /note="Description of Artificial Sequence: Synthetic oligonucleotide"
cugugcucuucg

SEQ ID NO: 1999 - RNA, 12 nt, Artificial Sequence
  source: /note="Description of Artificial Sequence: Synthetic oligonucleotide"
ugugcucuucgu

SEQ ID NO: 2000 - RNA, 12 nt, Artificial Sequence
  source: /note="Description of Artificial Sequence: Synthetic oligonucleotide"
gugcucuucguc

SEQ ID NO: 2001 - RNA, 12 nt, Artificial Sequence
  source: /note="Description of Artificial Sequence: Synthetic oligonucleotide"
ugcucuucguca

SEQ ID NO: 2002 - RNA, 12 nt, Artificial Sequence
  source: /note="Description of Artificial Sequence: Synthetic oligonucleotide"
gcucuucgucau

SEQ ID NO: 2003 - RNA, 12 nt, Artificial Sequence
  source: /note="Description of Artificial Sequence: Synthetic oligonucleotide"
cucuucgucauc

SEQ ID NO: 2004 - RNA, 12 nt, Artificial Sequence
  source: /note="Description of Artificial Sequence: Synthetic oligonucleotide"
ucuucgucaucu

SEQ ID NO: 2005 - RNA, 12 nt, Artificial Sequence
  source: /note="Description of Artificial Sequence: Synthetic oligonucleotide"
cuucgucaucug

SEQ ID NO: 2006 - RNA, 12 nt, Artificial Sequence
  source: /note="Description of Artificial Sequence: Synthetic oligonucleotide"
uucgucaucuga

SEQ ID NO: 2007 - RNA, 12 nt, Artificial Sequence
  source: /note="Description of Artificial Sequence: Synthetic oligonucleotide"
ucgucaucugac

SEQ ID NO: 2008 - RNA, 12 nt, Artificial Sequence
  source: /note="Description of Artificial Sequence: Synthetic oligonucleotide"
cgucaucugacc

SEQ ID NO: 2009 - RNA, 12 nt, Artificial Sequence
  source: /note="Description of Artificial Sequence: Synthetic oligonucleotide"
gucaucugacca

SEQ ID NO: 2010 - RNA, 12 nt, Artificial Sequence
  source: /note="Description of Artificial Sequence: Synthetic oligonucleotide"
ucaucugaccag

SEQ ID NO: 2011 - RNA, 12 nt, Artificial Sequence
  source: /note="Description of Artificial Sequence: Synthetic oligonucleotide"
ucugaccagccg

SEQ ID NO: 2012 - RNA, 12 nt, Artificial Sequence
  source: /note="Description of Artificial Sequence: Synthetic oligonucleotide"
cugaccagccga

SEQ ID NO: 2013 - RNA, 12 nt, Artificial Sequence
  source: /note="Description of Artificial Sequence: Synthetic oligonucleotide"
ugaccagccgac

SEQ ID NO: 2014 - RNA, 12 nt, Artificial Sequence
  source: /note="Description of Artificial Sequence: Synthetic oligonucleotide"
gaccagccgaca

SEQ ID NO: 2015 - RNA, 12 nt, Artificial Sequence
  source: /note="Description of Artificial Sequence: Synthetic oligonucleotide"
accagccgacac

SEQ ID NO: 2016 - RNA, 12 nt, Artificial Sequence
  source: /note="Description of Artificial Sequence: Synthetic oligonucleotide"
ccagccgacacc

SEQ ID NO: 2017 - RNA, 12 nt, Artificial Sequence
  source: /note="Description of Artificial Sequence: Synthetic oligonucleotide"
cagccgacacca

SEQ ID NO: 2018 - RNA, 12 nt, Artificial Sequence
  source: /note="Description of Artificial Sequence: Synthetic oligonucleotide"
agccgacaccaa

SEQ ID NO: 2019 - RNA, 12 nt, Artificial Sequence
  source: /note="Description of Artificial Sequence: Synthetic oligonucleotide"
gauggcccagaa

SEQ ID NO: 2020 - RNA, 12 nt, Artificial Sequence
  source: /note="Description of Artificial Sequence: Synthetic oligonucleotide"
auggcccagaau

SEQ ID NO: 2021 - RNA, 12 nt, Artificial Sequence
  source: /note="Description of Artificial Sequence: Synthetic oligonucleotide"
ccagaaugcagu

SEQ ID NO: 2022 - RNA, 12 nt, Artificial Sequence
  source: /note="Description of Artificial Sequence: Synthetic oligonucleotide"
cagaaugcaguu

SEQ ID NO: 2023 - RNA, 12 nt, Artificial Sequence
  source: /note="Description of Artificial Sequence: Synthetic oligonucleotide"
gaaugcaguucg

SEQ ID NO: 2024 - RNA, 12 nt, Artificial Sequence
  source: /note="Description of Artificial Sequence: Synthetic oligonucleotide"
aaugcaguucgc

SEQ ID NO: 2025 - RNA, 12 nt, Artificial Sequence
  source: /note="Description of Artificial Sequence: Synthetic oligonucleotide"
augcaguucgcc

SEQ ID NO: 2026 - RNA, 12 nt, Artificial Sequence
  source: /note="Description of Artificial Sequence: Synthetic oligonucleotide"
ugcaguucgccu

SEQ ID NO: 2027 - RNA, 12 nt, Artificial Sequence
  source: /note="Description of Artificial Sequence: Synthetic oligonucleotide"
gcaguucgccuu

SEQ ID NO: 2028 - RNA, 12 nt, Artificial Sequence
  source: /note="Description of Artificial Sequence: Synthetic oligonucleotide"
caguucgccuuc

SEQ ID NO: 2029 - RNA, 12 nt, Artificial Sequence
  source: /note="Description of Artificial Sequence: Synthetic oligonucleotide"
aguucgccuuca

SEQ ID NO: 2030 - RNA, 12 nt, Artificial Sequence
  source: /note="Description of Artificial Sequence: Synthetic oligonucleotide"
guucgccuucac

SEQ ID NO: 2031 - RNA, 12 nt, Artificial Sequence
  source: /note="Description of Artificial Sequence: Synthetic oligonucleotide"
uucgccuucacu

SEQ ID NO: 2032 - RNA, 12 nt, Artificial Sequence
  source: /note="Description of Artificial Sequence: Synthetic oligonucleotide"
ucgccuucacua

SEQ ID NO: 2033 - RNA, 12 nt, Artificial Sequence
  source: /note="Description of Artificial Sequence: Synthetic oligonucleotide"
cgccuucacuau

SEQ ID NO: 2034 - RNA, 12 nt, Artificial Sequence
  source: /note="Description of Artificial Sequence: Synthetic oligonucleotide"
ucacuauggacu

SEQ ID NO: 2035 - RNA, 12 nt, Artificial Sequence
  source: /note="Description of Artificial Sequence: Synthetic oligonucleotide"
cacuauggacua

SEQ ID NO: 2036 - RNA, 12 nt, Artificial Sequence
  source: /note="Description of Artificial Sequence: Synthetic oligonucleotide"
uggacuaccagu

SEQ ID NO: 2037 - RNA, 12 nt, Artificial Sequence
  source: /note="Description of Artificial Sequence: Synthetic oligonucleotide"
ggacuaccaguu

SEQ ID NO: 2038 - RNA, 12 nt, Artificial Sequence
  source: /note="Description of Artificial Sequence: Synthetic oligonucleotide"
gacuaccaguug

SEQ ID NO: 2039 - RNA, 12 nt, Artificial Sequence
  source: /note="Description of Artificial Sequence: Synthetic oligonucleotide"
acuaccaguugu

SEQ ID NO: 2040 - RNA, 12 nt, Artificial Sequence
  source: /note="Description of Artificial Sequence: Synthetic oligonucleotide"
cuaccaguugug

SEQ ID NO: 2041 - RNA, 12 nt, Artificial Sequence
  source: /note="Description of Artificial Sequence: Synthetic oligonucleotide"
uaccaguugugg

SEQ ID NO: 2042 - RNA, 12 nt, Artificial Sequence
  source: /note="Description of Artificial Sequence: Synthetic oligonucleotide"
accaguuguggu

SEQ ID NO: 2043 - RNA, 12 nt, Artificial Sequence
  source: /note="Description of Artificial Sequence: Synthetic oligonucleotide"
ccaguugugguu

SEQ ID NO: 2044 - RNA, 12 nt, Artificial Sequence
  source: /note="Description of Artificial Sequence: Synthetic oligonucleotide"
caguugugguua

SEQ ID NO: 2045 - RNA, 12 nt, Artificial Sequence
  source: /note="Description of Artificial Sequence: Synthetic oligonucleotide"
aguugugguuaa

SEQ ID NO: 2046 - RNA, 12 nt, Artificial Sequence
  source: /note="Description of Artificial Sequence: Synthetic oligonucleotide"
guugugguuaag

SEQ ID NO: 2047 - RNA, 12 nt, Artificial Sequence
  source: /note="Description of Artificial Sequence: Synthetic oligonucleotide"
uugugguuaagc

SEQ ID NO: 2048 - RNA, 12 nt, Artificial Sequence
  source: /note="Description of Artificial Sequence: Synthetic oligonucleotide"
ugugguuaagcu

SEQ ID NO: 2049 - RNA, 12 nt, Artificial Sequence
  source: /note="Description of Artificial Sequence: Synthetic oligonucleotide"
gugguuaagcuc

SEQ ID NO: 2050 - RNA, 12 nt, Artificial Sequence
  source: /note="Description of Artificial Sequence: Synthetic oligonucleotide"
ugguuaagcucu

SEQ ID NO: 2051 - RNA, 12 nt, Artificial Sequence
  source: /note="Description of Artificial Sequence: Synthetic oligonucleotide"
gguuaagcucuu

SEQ ID NO: 2052 - RNA, 12 nt, Artificial Sequence
  source: /note="Description of Artificial Sequence: Synthetic oligonucleotide"
aucccacuggcc

SEQ ID NO: 2053 - RNA, 12 nt, Artificial Sequence
  source: /note="Description of Artificial Sequence: Synthetic oligonucleotide"
ucccacuggccu

SEQ ID NO: 2054 - RNA, 12 nt, Artificial Sequence
  source: /note="Description of Artificial Sequence: Synthetic oligonucleotide"
cccacuggccuc

SEQ ID NO: 2055 - RNA, 12 nt, Artificial Sequence
  source: /note="Description of Artificial Sequence: Synthetic oligonucleotide"
ccacuggccucu

SEQ ID NO: 2056 - RNA, 12 nt, Artificial Sequence
  source: /note="Description of Artificial Sequence: Synthetic oligonucleotide"
cacuggccucug

SEQ ID NO: 2057 - RNA, 12 nt, Artificial Sequence
  source: /note="Description of Artificial Sequence: Synthetic oligonucleotide"
acuggccucuga

SEQ ID NO: 2058 - RNA, 12 nt, Artificial Sequence
  source: /note="Description of Artificial Sequence: Synthetic oligonucleotide"
cuggccucugau

SEQ ID NO: 2059 - RNA, 12 nt, Artificial Sequence
  source: /note="Description of Artificial Sequence: Synthetic oligonucleotide"
uggccucugaua

SEQ ID NO: 2060 - RNA, 12 nt, Artificial Sequence
  source: /note="Description of Artificial Sequence: Synthetic oligonucleotide"
ggccucugauaa

SEQ ID NO: 2061 - RNA, 12 nt, Artificial Sequence
  source: /note="Description of Artificial Sequence: Synthetic oligonucleotide"
gccucugauaaa

SEQ ID NO: 2062 - RNA, 12 nt, Artificial Sequence
  source: /note="Description of Artificial Sequence: Synthetic oligonucleotide"
ccucugauaaag

SEQ ID NO: 2063 - RNA, 12 nt, Artificial Sequence
  source: /note="Description of Artificial Sequence: Synthetic oligonucleotide"
cucugauaaagg

SEQ ID NO: 2064 - RNA, 12 nt, Artificial Sequence
  source: /note="Description of Artificial Sequence: Synthetic oligonucleotide"
ucugauaaaggc

SEQ ID NO: 2065 - RNA, 12 nt, Artificial Sequence
  source: /note="Description of Artificial Sequence: Synthetic oligonucleotide"
cugauaaaggcu

SEQ ID NO: 2066 - RNA, 12 nt, Artificial Sequence
  source: /note="Description of Artificial Sequence: Synthetic oligonucleotide"
ugauaaaggcua

SEQ ID NO: 2067 - RNA, 12 nt, Artificial Sequence
  source: /note="Description of Artificial Sequence: Synthetic oligonucleotide"
auaaaggcuacu

SEQ ID NO: 2068 - RNA, 12 nt, Artificial Sequence
  source: /note="Description of Artificial Sequence: Synthetic oligonucleotide"
uaaaggcuacug

SEQ ID NO: 2069 - RNA, 12 nt, Artificial Sequence
  source: /note="Description of Artificial Sequence: Synthetic oligonucleotide"
aaaggcuacugu

SEQ ID NO: 2070 - RNA, 12 nt, Artificial Sequence
  source: /note="Description of Artificial Sequence: Synthetic oligonucleotide"
aaggcuacuguu

SEQ ID NO: 2071 - RNA, 12 nt, Artificial Sequence
  source: /note="Description of Artificial Sequence: Synthetic oligonucleotide"
ggcuacuguugg

SEQ ID NO: 2072 - RNA, 12 nt, Artificial Sequence
  source: /note="Description of Artificial Sequence: Synthetic oligonucleotide"
gcuacuguugga

SEQ ID NO: 2073 - RNA, 12 nt, Artificial Sequence
  source: /note="Description of Artificial Sequence: Synthetic oligonucleotide"
cuacuguuggau

SEQ ID NO: 2074 - RNA, 12 nt, Artificial Sequence
  source: /note="Description of Artificial Sequence: Synthetic oligonucleotide"
acuguuggauug

SEQ ID NO: 2075 - RNA, 12 nt, Artificial Sequence
  source: /note="Description of Artificial Sequence: Synthetic oligonucleotide"
cuguuggauuga

SEQ ID NO: 2076 - RNA, 12 nt, Artificial Sequence
  source: /note="Description of Artificial Sequence: Synthetic oligonucleotide"
uguuggauugau

SEQ ID NO: 2077 - RNA, 12 nt, Artificial Sequence
  source: /note="Description of Artificial Sequence: Synthetic oligonucleotide"
guuggauugauu

SEQ ID NO: 2078 - RNA, 12 nt, Artificial Sequence
  source: /note="Description of Artificial Sequence: Synthetic oligonucleotide"
uuggauugauuc

SEQ ID NO: 2079 - RNA, 12 nt, Artificial Sequence
  source: /note="Description of Artificial Sequence: Synthetic oligonucleotide"
uggauugauucg

SEQ ID NO: 2080 - RNA, 12 nt, Artificial Sequence
  source: /note="Description of Artificial Sequence: Synthetic oligonucleotide"
ggauugauucga

SEQ ID NO: 2081 - RNA, 12 nt, Artificial Sequence
  source: /note="Description of Artificial Sequence: Synthetic oligonucleotide"
gauugauucgaa

SEQ ID NO: 2082 - RNA, 12 nt, Artificial Sequence
  source: /note="Description of Artificial Sequence: Synthetic oligonucleotide"
auugauucgaaa

SEQ ID NO: 2083 - RNA, 12 nt, Artificial Sequence
  source: /note="Description of Artificial Sequence: Synthetic oligonucleotide"
uugauucgaaau

SEQ ID NO: 2084 - RNA, 12 nt, Artificial Sequence
  source: /note="Description of Artificial Sequence: Synthetic oligonucleotide"
gcgugagcaggg

SEQ ID NO: 2085 - RNA, 12 nt, Artificial Sequence
  source: /note="Description of Artificial Sequence: Synthetic oligonucleotide"
cgugagcagggu

SEQ ID NO: 2086 - RNA, 12 nt, Artificial Sequence
  source: /note="Description of Artificial Sequence: Synthetic oligonucleotide"
gugagcagggug

SEQ ID NO: 2087 - RNA, 12 nt, Artificial Sequence
  source: /note="Description of Artificial Sequence: Synthetic oligonucleotide"
ugagcagggugc

SEQ ID NO: 2088 - RNA, 12 nt, Artificial Sequence
  source: /note="Description of Artificial Sequence: Synthetic oligonucleotide"
gagcagggugcc

SEQ ID NO: 2089 - RNA, 12 nt, Artificial Sequence
  source: /note="Description of Artificial Sequence: Synthetic oligonucleotide"
agcagggugcca

SEQ ID NO: 2090 - RNA, 12 nt, Artificial Sequence
  source: /note="Description of Artificial Sequence: Synthetic oligonucleotide"
gcagggugccau

SEQ ID NO: 2091 - RNA, 12 nt, Artificial Sequence
  source: /note="Description of Artificial Sequence: Synthetic oligonucleotide"
gugccauuccac

SEQ ID NO: 2092 - RNA, 12 nt, Artificial Sequence
  source: /note="Description of Artificial Sequence: Synthetic oligonucleotide"
ugccauuccacg

SEQ ID NO: 2093 - RNA, 12 nt, Artificial Sequence
  source: /note="Description of Artificial Sequence: Synthetic oligonucleotide"
gccauuccacga

SEQ ID NO: 2094 - RNA, 12 nt, Artificial Sequence
  source: /note="Description of Artificial Sequence: Synthetic oligonucleotide"
ccauuccacgac

SEQ ID NO: 2095 - RNA, 12 nt, Artificial Sequence
  source: /note="Description of Artificial Sequence: Synthetic oligonucleotide"
cauuccacgacu

SEQ ID NO: 2096 - RNA, 12 nt, Artificial Sequence
  source: /note="Description of Artificial Sequence: Synthetic oligonucleotide"
auuccacgacua

SEQ ID NO: 2097 - RNA, 12 nt, Artificial Sequence
  source: /note="Description of Artificial Sequence: Synthetic oligonucleotide"
uuccacgacuag

SEQ ID NO: 2098 - RNA, 12 nt, Artificial Sequence
  source: /note="Description of Artificial Sequence: Synthetic oligonucleotide"
uccacgacuagu

SEQ ID NO: 2099 - RNA, 12 nt, Artificial Sequence
  source: /note="Description of Artificial Sequence: Synthetic oligonucleotide"
ccacgacuaguu

SEQ ID NO: 2100 - RNA, 12 nt, Artificial Sequence
  source: /note="Description of Artificial Sequence: Synthetic oligonucleotide"
cacgacuaguuc

SEQ ID NO: 2101 - RNA, 12 nt, Artificial Sequence
  source: /note="Description of Artificial Sequence: Synthetic oligonucleotide"
acgacuaguuca

SEQ ID NO: 2102 - RNA, 12 nt, Artificial Sequence
  source: /note="Description of Artificial Sequence: Synthetic oligonucleotide"
cgacuaguucag

SEQ ID NO: 2103 - RNA, 12 nt, Artificial Sequence
  source: /note="Description of Artificial Sequence: Synthetic oligonucleotide"
gacuaguucagu

SEQ ID NO: 2104 - RNA, 12 nt, Artificial Sequence
  source: /note="Description of Artificial Sequence: Synthetic oligonucleotide"
acuaguucaguu

SEQ ID NO: 2105 - RNA, 12 nt, Artificial Sequence
  source: /note="Description of Artificial Sequence: Synthetic oligonucleotide"
cuaguucaguug

SEQ ID NO: 2106 - RNA, 12 nt, Artificial Sequence
  source: /note="Description of Artificial Sequence: Synthetic oligonucleotide"
uaguucaguugc

SEQ ID NO: 2107 - RNA, 12 nt, Artificial Sequence
  source: /note="Description of Artificial Sequence: Synthetic oligonucleotide"
aguucaguugcu

SEQ ID NO: 2108 - RNA, 12 nt, Artificial Sequence
  source: /note="Description of Artificial Sequence: Synthetic oligonucleotide"
guucaguugcuu

SEQ ID NO: 2109 - RNA, 12 nt, Artificial Sequence
  source: /note="Description of Artificial Sequence: Synthetic oligonucleotide"
uucaguugcuug

SEQ ID NO: 2110 - RNA, 12 nt, Artificial Sequence
  source: /note="Description of Artificial Sequence: Synthetic oligonucleotide"
ucaguugcuugu

SEQ ID NO: 2111 - RNA, 12 nt, Artificial Sequence
  source: /note="Description of Artificial Sequence: Synthetic oligonucleotide"
caguugcuuguu

SEQ ID NO: 2112 - RNA, 12 nt, Artificial Sequence
  source: /note="Description of Artificial Sequence: Synthetic oligonucleotide"
guugcuuguucg

SEQ ID NO: 2113 - RNA, 12 nt, Artificial Sequence
  source: /note="Description of Artificial Sequence: Synthetic oligonucleotide"
uugcuuguucgu

SEQ ID NO: 2114 - RNA, 12 nt, Artificial Sequence
  source: /note="Description of Artificial Sequence: Synthetic oligonucleotide"
uguucgugcaca

SEQ ID NO: 2115 - RNA, 12 nt, Artificial Sequence
  source: /note="Description of Artificial Sequence: Synthetic oligonucleotide"
guucgugcacau

SEQ ID NO: 2116 - RNA, 12 nt, Artificial Sequence
  source: /note="Description of Artificial Sequence: Synthetic oligonucleotide"
uucgugcacauc

SEQ ID NO: 2117 - RNA, 12 nt, Artificial Sequence
  source: /note="Description of Artificial Sequence: Synthetic oligonucleotide"
ucgugcacauca

SEQ ID NO: 2118 - RNA, 12 nt, Artificial Sequence
  source: /note="Description of Artificial Sequence: Synthetic oligonucleotide"
cgugcacaucag

SEQ ID NO: 2119 - RNA, 12 nt, Artificial Sequence
  source: /note="Description of Artificial Sequence: Synthetic oligonucleotide"
gugcacaucagg

SEQ ID NO: 2120 - RNA, 12 nt, Artificial Sequence
  source: /note="Description of Artificial Sequence: Synthetic oligonucleotide"
ugcacaucagga

SEQ ID NO: 2121 - RNA, 12 nt, Artificial Sequence
  source: /note="Description of Artificial Sequence: Synthetic oligonucleotide"
gcacaucaggau

SEQ ID NO: 2122 - RNA, 12 nt, Artificial Sequence
  source: /note="Description of Artificial Sequence: Synthetic oligonucleotide"
cccagcgccgua

SEQ ID NO: 2123 - RNA, 12 nt, Artificial Sequence
  source: /note="Description of Artificial Sequence: Synthetic oligonucleotide"
ccagcgccguac

SEQ ID NO: 2124 - RNA, 12 nt, Artificial Sequence
  source: /note="Description of Artificial Sequence: Synthetic oligonucleotide"
cagcgccguacg

SEQ ID NO: 2125 - RNA, 12 nt, Artificial Sequence
  source: /note="Description of Artificial Sequence: Synthetic oligonucleotide"
agcgccguacgu

SEQ ID NO: 2126 - RNA, 12 nt, Artificial Sequence
  source: /note="Description of Artificial Sequence: Synthetic oligonucleotide"
gcgccguacguc

SEQ ID NO: 2127 - RNA, 12 nt, Artificial Sequence
  source: /note="Description of Artificial Sequence: Synthetic oligonucleotide"
cgccguacgucc

SEQ ID NO: 2128 - RNA, 12 nt, Artificial Sequence
  source: /note="Description of Artificial Sequence: Synthetic oligonucleotide"
ggugggacacag

SEQ ID NO: 2129 - RNA, 12 nt, Artificial Sequence
  source: /note="Description of Artificial Sequence: Synthetic oligonucleotide"
gugggacacagc

SEQ ID NO: 2130 - RNA, 12 nt, Artificial Sequence
  source: /note="Description of Artificial Sequence: Synthetic oligonucleotide"
ugggacacagca

SEQ ID NO: 2131 - RNA, 12 nt, Artificial Sequence
  source: /note="Description of Artificial Sequence: Synthetic oligonucleotide"
gggacacagcag

SEQ ID NO: 2132 - RNA, 12 nt, Artificial Sequence
  source: /note="Description of Artificial Sequence: Synthetic oligonucleotide"
ggacacagcagc

SEQ ID NO: 2133 - RNA, 12 nt, Artificial Sequence
  source: /note="Description of Artificial Sequence: Synthetic oligonucleotide"
gacacagcagca

SEQ ID NO: 2134 - RNA, 12 nt, Artificial Sequence
  source: /note="Description of Artificial Sequence: Synthetic oligonucleotide"
acacagcagcaa

SEQ ID NO: 2135 - RNA, 12 nt, Artificial Sequence
  source: /note="Description of Artificial Sequence: Synthetic oligonucleotide"
cacagcagcaau

SEQ ID NO: 2136 - RNA, 12 nt, Artificial Sequence
  source: /note="Description of Artificial Sequence: Synthetic oligonucleotide"
acagcagcaauu

SEQ ID NO: 2137 - RNA, 12 nt, Artificial Sequence
  source: /note="Description of Artificial Sequence: Synthetic oligonucleotide"
ggguccgcaugg

SEQ ID NO: 2138 - RNA, 12 nt, Artificial Sequence
  source: /note="Description of Artificial Sequence: Synthetic oligonucleotide"
gguccgcaugga

SEQ ID NO: 2139 - RNA, 12 nt, Artificial Sequence
  source: /note="Description of Artificial Sequence: Synthetic oligonucleotide"
guccgcauggaa

SEQ ID NO: 2140 - RNA, 12 nt, Artificial Sequence
  source: /note="Description of Artificial Sequence: Synthetic oligonucleotide"
uccgcauggaag

SEQ ID NO: 2141 - RNA, 12 nt, Artificial Sequence
  source: /note="Description of Artificial Sequence: Synthetic oligonucleotide"
ccgcauggaaga

SEQ ID NO: 2142 - RNA, 12 nt, Artificial Sequence
  source: /note="Description of Artificial Sequence: Synthetic oligonucleotide"
cgcauggaagaa

SEQ ID NO: 2143 - RNA, 12 nt, Artificial Sequence
  source: /note="Description of Artificial Sequence: Synthetic oligonucleotide"
gcauggaagaaa

SEQ ID NO: 2144 - RNA, 12 nt, Artificial Sequence
  source: /note="Description of Artificial Sequence: Synthetic oligonucleotide"
cauccuagcucg

SEQ ID NO: 2145 - RNA, 12 nt, Artificial Sequence
  source: /note="Description of Artificial Sequence: Synthetic oligonucleotide"
auccuagcucgg

SEQ ID NO: 2146 - RNA, 12 nt, Artificial Sequence
  source: /note="Description of Artificial Sequence: Synthetic oligonucleotide"
uccuagcucggg

SEQ ID NO: 2147 - RNA, 12 nt, Artificial Sequence
  source: /note="Description of Artificial Sequence: Synthetic oligonucleotide"
ccuagcucggga

SEQ ID NO: 2148 - RNA, 12 nt, Artificial Sequence
  source: /note="Description of Artificial Sequence: Synthetic oligonucleotide"
cuagcucgggau

SEQ ID NO: 2149 - RNA, 12 nt, Artificial Sequence
  source: /note="Description of Artificial Sequence: Synthetic oligonucleotide"
uagcucgggaug

SEQ ID NO: 2150 - RNA, 12 nt, Artificial Sequence
  source: /note="Description of Artificial Sequence: Synthetic oligonucleotide"
agcucgggaugu

SEQ ID NO: 2151 - RNA, 12 nt, Artificial Sequence
  source: /note="Description of Artificial Sequence: Synthetic oligonucleotide"
gcucgggauguu

SEQ ID NO: 2152 - RNA, 12 nt, Artificial Sequence
  source: /note="Description of Artificial Sequence: Synthetic oligonucleotide"
cgggauguucac

SEQ ID NO: 2153 - RNA, 12 nt, Artificial Sequence
  source: /note="Description of Artificial Sequence: Synthetic oligonucleotide"
gggauguucaca

SEQ ID NO: 2154 - RNA, 12 nt, Artificial Sequence
  source: /note="Description of Artificial Sequence: Synthetic oligonucleotide"
ggauguucacaa

SEQ ID NO: 2155 - RNA, 12 nt, Artificial Sequence
  source: /note="Description of Artificial Sequence: Synthetic oligonucleotide"
gauguucacaac

SEQ ID NO: 2156 - RNA, 12 nt, Artificial Sequence
  source: /note="Description of Artificial Sequence: Synthetic oligonucleotide"
auguucacaacc

SEQ ID NO: 2157 - RNA, 12 nt, Artificial Sequence
  source: /note="Description of Artificial Sequence: Synthetic oligonucleotide"
uguucacaaccg

SEQ ID NO: 2158 - RNA, 12 nt, Artificial Sequence
  source: /note="Description of Artificial Sequence: Synthetic oligonucleotide"
guucacaaccga

SEQ ID NO: 2159 - RNA, 12 nt, Artificial Sequence
  source: /note="Description of Artificial Sequence: Synthetic oligonucleotide"
uucacaaccgaa

SEQ ID NO: 2160 - RNA, 12 nt, Artificial Sequence
  source: /note="Description of Artificial Sequence: Synthetic oligonucleotide"
ucacaaccgaau

SEQ ID NO: 2161 - RNA, 12 nt, Artificial Sequence
  source: /note="Description of Artificial Sequence: Synthetic oligonucleotide"
cacaaccgaauu

SEQ ID NO: 2162 - RNA, 12 nt, Artificial Sequence
  source: /note="Description of Artificial Sequence: Synthetic oligonucleotide"
ggacuaaauacc

SEQ ID NO: 2163 - RNA, 12 nt, Artificial Sequence
  source: /note="Description of Artificial Sequence: Synthetic oligonucleotide"
gacuaaauacca

SEQ ID NO: 2164 - RNA, 12 nt, Artificial Sequence
  source: /note="Description of Artificial Sequence: Synthetic oligonucleotide"
acuaaauaccau

SEQ ID NO: 2165 - RNA, 12 nt, Artificial Sequence
  source: /note="Description of Artificial Sequence: Synthetic oligonucleotide"
cuaaauaccauu

SEQ ID NO: 2166 - RNA, 12 nt, Artificial Sequence
  source: /note="Description of Artificial Sequence: Synthetic oligonucleotide"
uaaauaccauuc

SEQ ID NO: 2167 - RNA, 12 nt, Artificial Sequence
  source: /note="Description of Artificial Sequence: Synthetic oligonucleotide"
aaauaccauucc

SEQ ID NO: 2168 - RNA, 12 nt, Artificial Sequence
  source: /note="Description of Artificial Sequence: Synthetic oligonucleotide"
aauaccauucca

SEQ ID NO: 2169 - RNA, 12 nt, Artificial Sequence
  source: /note="Description of Artificial Sequence: Synthetic oligonucleotide"
auaccauuccau

SEQ ID NO: 2170 - RNA, 12 nt, Artificial Sequence
  source: /note="Description of Artificial Sequence: Synthetic oligonucleotide"
uaccauuccauu

SEQ ID NO: 2171 - RNA, 12 nt, Artificial Sequence
  source: /note="Description of Artificial Sequence: Synthetic oligonucleotide"
accauuccauug

SEQ ID NO: 2172 - RNA, 12 nt, Artificial Sequence
  source: /note="Description of Artificial Sequence: Synthetic oligonucleotide"
ccauuccauugu

SEQ ID NO: 2173 - RNA, 12 nt, Artificial Sequence
  source: /note="Description of Artificial Sequence: Synthetic oligonucleotide"
cauuccauuguu

SEQ ID NO: 2174 - RNA, 12 nt, Artificial Sequence
  source: /note="Description of Artificial Sequence: Synthetic oligonucleotide"
auuccauuguuu

SEQ ID NO: 2175 - RNA, 12 nt, Artificial Sequence
  source: /note="Description of Artificial Sequence: Synthetic oligonucleotide"
uuccauuguuug

SEQ ID NO: 2176 - RNA, 12 nt, Artificial Sequence
  source: /note="Description of Artificial Sequence: Synthetic oligonucleotide"
uccauuguuugu

SEQ ID NO: 2177 - RNA, 12 nt, Artificial Sequence
  source: /note="Description of Artificial Sequence: Synthetic oligonucleotide"
uuguuugugcag

SEQ ID NO: 2178 - RNA, 12 nt, Artificial Sequence
  source: /note="Description of Artificial Sequence: Synthetic oligonucleotide"
uguuugugcagc

SEQ ID NO: 2179 - RNA, 12 nt, Artificial Sequence
  source: /note="Description of Artificial Sequence: Synthetic oligonucleotide"
guuugugcagcu

SEQ ID NO: 2180 - RNA, 12 nt, Artificial Sequence
  source: /note="Description of Artificial Sequence: Synthetic oligonucleotide"
uuugugcagcug

SEQ ID NO: 2181 - RNA, 12 nt, Artificial Sequence
  source: /note="Description of Artificial Sequence: Synthetic oligonucleotide"
uugugcagcugc

SEQ ID NO: 2182 - RNA, 12 nt, Artificial Sequence
  source: /note="Description of Artificial Sequence: Synthetic oligonucleotide"
ugugcagcugcu

SEQ ID NO: 2183 - RNA, 12 nt, Artificial Sequence
  source: /note="Description of Artificial Sequence: Synthetic oligonucleotide"
gugcagcugcuu

SEQ ID NO: 2184 - RNA, 12 nt, Artificial Sequence
  source: /note="Description of Artificial Sequence: Synthetic oligonucleotide"
ugcagcugcuuu

SEQ ID NO: 2185 - RNA, 12 nt, Artificial Sequence
  source: /note="Description of Artificial Sequence: Synthetic oligonucleotide"
gcagcugcuuua

SEQ ID NO: 2186 - RNA, 12 nt, Artificial Sequence
  source: /note="Description of Artificial Sequence: Synthetic oligonucleotide"
cagcugcuuuau

SEQ ID NO: 2187 - RNA, 12 nt, Artificial Sequence
  source: /note="Description of Artificial Sequence: Synthetic oligonucleotide"
agcugcuuuauu

SEQ ID NO: 2188 - RNA, 12 nt, Artificial Sequence
  source: /note="Description of Artificial Sequence: Synthetic oligonucleotide"
gcugcuuuauuc

SEQ ID NO: 2189 - RNA, 12 nt, Artificial Sequence
  source: /note="Description of Artificial Sequence: Synthetic oligonucleotide"
cugcuuuauucu

SEQ ID NO: 2190 - RNA, 12 nt, Artificial Sequence
  source: /note="Description of Artificial Sequence: Synthetic oligonucleotide"
ugcuuuauucuc

SEQ ID NO: 2191 - RNA, 12 nt, Artificial Sequence
  source: /note="Description of Artificial Sequence: Synthetic oligonucleotide"
gcuuuauucucc

SEQ ID NO: 2192 - RNA, 12 nt, Artificial Sequence
  source: /note="Description of Artificial Sequence: Synthetic oligonucleotide"
cuuuauucuccc

SEQ ID NO: 2193 - RNA, 12 nt, Artificial Sequence
  source: /note="Description of Artificial Sequence: Synthetic oligonucleotide"
uuuauucuccca

SEQ ID NO: 2194 - RNA, 12 nt, Artificial Sequence
  source: /note="Description of Artificial Sequence: Synthetic oligonucleotide"
uuauucucccau

SEQ ID NO: 2195 - RNA, 12 nt, Artificial Sequence
  source: /note="Description of Artificial Sequence: Synthetic oligonucleotide"
uauucucccauu

SEQ ID NO: 2196 - RNA, 12 nt, Artificial Sequence
  source: /note="Description of Artificial Sequence: Synthetic oligonucleotide"
auucucccauug

SEQ ID NO: 2197 - RNA, 12 nt, Artificial Sequence
  source: /note="Description of Artificial Sequence: Synthetic oligonucleotide"
uucucccauuga

SEQ ID NO: 2198 - RNA, 12 nt, Artificial Sequence
  source: /note="Description of Artificial Sequence: Synthetic oligonucleotide"
ucucccauugaa

SEQ ID NO: 2199 - RNA, 12 nt, Artificial Sequence
  source: /note="Description of Artificial Sequence: Synthetic oligonucleotide"
cucccauugaaa

SEQ ID NO: 2200 - RNA, 12 nt, Artificial Sequence
  source: /note="Description of Artificial Sequence: Synthetic oligonucleotide"
ucccauugaaaa

SEQ ID NO: 2201 - RNA, 12 nt, Artificial Sequence
  source: /note="Description of Artificial Sequence: Synthetic oligonucleotide"
cccauugaaaac

SEQ ID NO: 2202 - RNA, 12 nt, Artificial Sequence
  source: /note="Description of Artificial Sequence: Synthetic oligonucleotide"
ccauugaaaaca

SEQ ID NO: 2203 - RNA, 12 nt, Artificial Sequence
  source: /note="Description of Artificial Sequence: Synthetic oligonucleotide"
cauugaaaacau

SEQ ID NO: 2204 - RNA, 12 nt, Artificial Sequence
  source: /note="Description of Artificial Sequence: Synthetic oligonucleotide"
aagaguagcugc

SEQ ID NO: 2205 - RNA, 12 nt, Artificial Sequence
  source: /note="Description of Artificial Sequence: Synthetic oligonucleotide"
agaguagcugca

SEQ ID NO: 2206 - RNA, 12 nt, Artificial Sequence
  source: /note="Description of Artificial Sequence: Synthetic oligonucleotide"
gaguagcugcag

SEQ ID NO: 2207 - RNA, 12 nt, Artificial Sequence
  source: /note="Description of Artificial Sequence: Synthetic oligonucleotide"
guagcugcaggg

SEQ ID NO: 2208 - RNA, 12 nt, Artificial Sequence
  source: /note="Description of Artificial Sequence: Synthetic oligonucleotide"
uagcugcagggg

SEQ ID NO: 2209 - RNA, 12 nt, Artificial Sequence
  source: /note="Description of Artificial Sequence: Synthetic oligonucleotide"
agcugcaggggu

SEQ ID NO: 2210 - RNA, 12 nt, Artificial Sequence
  source: /note="Description of Artificial Sequence: Synthetic oligonucleotide"
gcugcagggguc

SEQ ID NO: 2211 - RNA, 12 nt, Artificial Sequence
  source: /note="Description of Artificial Sequence: Synthetic oligonucleotide"
cugcaggggucc

SEQ ID NO: 2212 - RNA, 12 nt, Artificial Sequence
  source: /note="Description of Artificial Sequence: Synthetic oligonucleotide"
ugcagggguccu

SEQ ID NO: 2213 - RNA, 12 nt, Artificial Sequence
  source: /note="Description of Artificial Sequence: Synthetic oligonucleotide"
gcagggguccuc

SEQ ID NO: 2214 - RNA, 12 nt, Artificial Sequence
  source: /note="Description of Artificial Sequence: Synthetic oligonucleotide"
cagggguccucu

SEQ ID NO: 2215 - RNA, 12 nt, Artificial Sequence
  source: /note="Description of Artificial Sequence: Synthetic oligonucleotide"
agggguccucug

SEQ ID NO: 2216 - RNA, 12 nt, Artificial Sequence
  source: /note="Description of Artificial Sequence: Synthetic oligonucleotide"
gggguccucugu

SEQ ID NO: 2217 - RNA, 12 nt, Artificial Sequence
  source: /note="Description of Artificial Sequence: Synthetic oligonucleotide"
ggguccucugug

SEQ ID NO: 2218 - RNA, 12 nt, Artificial Sequence
  source: /note="Description of Artificial Sequence: Synthetic oligonucleotide"
gguccucuguga

SEQ ID NO: 2219 - RNA, 12 nt, Artificial Sequence
  source: /note="Description of Artificial Sequence: Synthetic oligonucleotide"
guccucugugaa

SEQ ID NO: 2220 - RNA, 12 nt, Artificial Sequence
  source: /note="Description of Artificial Sequence: Synthetic oligonucleotide"
uccucugugaac

SEQ ID NO: 2221 - RNA, 12 nt, Artificial Sequence
  source: /note="Description of Artificial Sequence: Synthetic oligonucleotide"
ccucugugaacu

SEQ ID NO: 2222 - RNA, 12 nt, Artificial Sequence
  source: /note="Description of Artificial Sequence: Synthetic oligonucleotide"
cucugugaacuu

SEQ ID NO: 2223 - RNA, 12 nt, Artificial Sequence
  source: /note="Description of Artificial Sequence: Synthetic oligonucleotide"
ucugugaacuug

SEQ ID NO: 2224 - RNA, 12 nt, Artificial Sequence
  source: /note="Description of Artificial Sequence: Synthetic oligonucleotide"
cugugaacuugc

SEQ ID NO: 2225 - RNA, 12 nt, Artificial Sequence
  source: /note="Description of Artificial Sequence: Synthetic oligonucleotide"
ugugaacuugcu

SEQ ID NO: 2226 - RNA, 12 nt, Artificial Sequence
  source: /note="Description of Artificial Sequence: Synthetic oligonucleotide"
gugaacuugcuc

SEQ ID NO: 2227 - RNA, 12 nt, Artificial Sequence
  source: /note="Description of Artificial Sequence: Synthetic oligonucleotide"
ugaacuugcuca

SEQ ID NO: 2228 - RNA, 12 nt, Artificial Sequence
  source: /note="Description of Artificial Sequence: Synthetic oligonucleotide"
gaacuugcucag

SEQ ID NO: 2229 - RNA, 12 nt, Artificial Sequence
  source: /note="Description of Artificial Sequence: Synthetic oligonucleotide"
aacuugcucagg

SEQ ID NO: 2230 - RNA, 12 nt, Artificial Sequence
  source: /note="Description of Artificial Sequence: Synthetic oligonucleotide"
acuugcucagga

SEQ ID NO: 2231 - RNA, 12 nt, Artificial Sequence
  source: /note="Description of Artificial Sequence: Synthetic oligonucleotide"
cuugcucaggac

SEQ ID NO: 2232 - RNA, 12 nt, Artificial Sequence
  source: /note="Description of Artificial Sequence: Synthetic oligonucleotide"
uugcucaggaca

SEQ ID NO: 2233 - RNA, 12 nt, Artificial Sequence
  source: /note="Description of Artificial Sequence: Synthetic oligonucleotide"
ugcucaggacaa

SEQ ID NO: 2234 - RNA, 12 nt, Artificial Sequence
  source: /note="Description of Artificial Sequence: Synthetic oligonucleotide"
gcucaggacaag

SEQ ID NO: 2235 - RNA, 12 nt, Artificial Sequence
  source: /note="Description of Artificial Sequence: Synthetic oligonucleotide"
cucaggacaagg

SEQ ID NO: 2236 - RNA, 12 nt, Artificial Sequence
  source: /note="Description of Artificial Sequence: Synthetic oligonucleotide"
ucaggacaagga

SEQ ID NO: 2237 - RNA, 12 nt, Artificial Sequence
  source: /note="Description of Artificial Sequence: Synthetic oligonucleotide"
agcuccucugac

SEQ ID NO: 2238 - RNA, 12 nt, Artificial Sequence
  source: /note="Description of Artificial Sequence: Synthetic oligonucleotide"
gcuccucugaca

SEQ ID NO: 2239 - RNA, 12 nt, Artificial Sequence
  source: /note="Description of Artificial Sequence: Synthetic oligonucleotide"
cuccucugacag

SEQ ID NO: 2240 - RNA, 12 nt, Artificial Sequence
  source: /note="Description of Artificial Sequence: Synthetic oligonucleotide"
uccucugacaga

SEQ ID NO: 2241 - RNA, 12 nt, Artificial Sequence
  source: /note="Description of Artificial Sequence: Synthetic oligonucleotide"
ccucugacagag

SEQ ID NO: 2242 - RNA, 12 nt, Artificial Sequence
  source: /note="Description of Artificial Sequence: Synthetic oligonucleotide"
cucugacagagu

SEQ ID NO: 2243 - RNA, 12 nt, Artificial Sequence
  source: /note="Description of Artificial Sequence: Synthetic oligonucleotide"
ucugacagaguu

SEQ ID NO: 2244 - RNA, 12 nt, Artificial Sequence
  source: /note="Description of Artificial Sequence: Synthetic oligonucleotide"
cugacagaguua

SEQ ID NO: 2245 - RNA, 12 nt, Artificial Sequence
  source: /note="Description of Artificial Sequence: Synthetic oligonucleotide"
acagaguuacuu

SEQ ID NO: 2246 - RNA, 12 nt, Artificial Sequence
  source: /note="Description of Artificial Sequence: Synthetic oligonucleotide"
gaguuacuucac

SEQ ID NO: 2247 - RNA, 12 nt, Artificial Sequence
  source: /note="Description of Artificial Sequence: Synthetic oligonucleotide"
aguuacuucacu

SEQ ID NO: 2248 - RNA, 12 nt, Artificial Sequence
  source: /note="Description of Artificial Sequence: Synthetic oligonucleotide"
guuacuucacuc

SEQ ID NO: 2249 - RNA, 12 nt, Artificial Sequence
  source: /note="Description of Artificial Sequence: Synthetic oligonucleotide"
uuacuucacucu

SEQ ID NO: 2250 - RNA, 12 nt, Artificial Sequence
  source: /note="Description of Artificial Sequence: Synthetic oligonucleotide"
uacuucacucua

SEQ ID NO: 2251 - RNA, 12 nt, Artificial Sequence
  source: /note="Description of Artificial Sequence: Synthetic oligonucleotide"
acuucacucuag

SEQ ID NO: 2252 - RNA, 12 nt, Artificial Sequence
  source: /note="Description of Artificial Sequence: Synthetic oligonucleotide"
cuucacucuagg

SEQ ID NO: 2253 - RNA, 12 nt, Artificial Sequence
  source: /note="Description of Artificial Sequence: Synthetic oligonucleotide"
uucacucuagga

SEQ ID NO: 2254 - RNA, 12 nt, Artificial Sequence
  source: /note="Description of Artificial Sequence: Synthetic oligonucleotide"
ucacucuaggaa

SEQ ID NO: 2255 - RNA, 12 nt, Artificial Sequence
  source: /note="Description of Artificial Sequence: Synthetic oligonucleotide"
cacucuaggaau

SEQ ID NO: 2256 - RNA, 12 nt, Artificial Sequence
  source: /note="Description of Artificial Sequence: Synthetic oligonucleotide"
cugcuguuuugu

SEQ ID NO: 2257 - RNA, 12 nt, Artificial Sequence
  source: /note="Description of Artificial Sequence: Synthetic oligonucleotide"
ugcuguuuuguu

SEQ ID NO: 2258 - RNA, 12 nt, Artificial Sequence
  source: /note="Description of Artificial Sequence: Synthetic oligonucleotide"
gcuguuuuguuc

SEQ ID NO: 2259 - RNA, 12 nt, Artificial Sequence
  source: /note="Description of Artificial Sequence: Synthetic oligonucleotide"
cuguuuuguucc

SEQ ID NO: 2260 - RNA, 12 nt, Artificial Sequence
  source: /note="Description of Artificial Sequence: Synthetic oligonucleotide"
uguuuuguuccg

SEQ ID NO: 2261 - RNA, 12 nt, Artificial Sequence
  source: /note="Description of Artificial Sequence: Synthetic oligonucleotide"
guuuuguuccga

SEQ ID NO: 2262 - RNA, 12 nt, Artificial Sequence
  source: /note="Description of Artificial Sequence: Synthetic oligonucleotide"
uuuuguuccgaa

SEQ ID NO: 2263 - RNA, 12 nt, Artificial Sequence
  source: /note="Description of Artificial Sequence: Synthetic oligonucleotide"
ugaggacaagcc

SEQ ID NO: 2264 - RNA, 12 nt, Artificial Sequence
  source: /note="Description of Artificial Sequence: Synthetic oligonucleotide"
gaggacaagcca

SEQ ID NO: 2265 - RNA, 12 nt, Artificial Sequence
  source: /note="Description of Artificial Sequence: Synthetic oligonucleotide"
aggacaagccac

SEQ ID NO: 2266 - RNA, 12 nt, Artificial Sequence
  source: /note="Description of Artificial Sequence: Synthetic oligonucleotide"
ggacaagccaca

SEQ ID NO: 2267 - RNA, 12 nt, Artificial Sequence
  source: /note="Description of Artificial Sequence: Synthetic oligonucleotide"
gacaagccacaa

SEQ ID NO: 2268 - RNA, 12 nt, Artificial Sequence
  source: /note="Description of Artificial Sequence: Synthetic oligonucleotide"
acaagccacaag

SEQ ID NO: 2269 - RNA, 12 nt, Artificial Sequence
  source: /note="Description of Artificial Sequence: Synthetic oligonucleotide"
caagccacaaga

SEQ ID NO: 2270 - RNA, 12 nt, Artificial Sequence
  source: /note="Description of Artificial Sequence: Synthetic oligonucleotide"
aagccacaagau

SEQ ID NO: 2271 - RNA, 12 nt, Artificial Sequence
  source: /note="Description of Artificial Sequence: Synthetic oligonucleotide"
agccacaagauu

SEQ ID NO: 2272 - RNA, 12 nt, Artificial Sequence
  source: /note="Description of Artificial Sequence: Synthetic oligonucleotide"
gccacaagauua

SEQ ID NO: 2273 - RNA, 12 nt, Artificial Sequence
  source: /note="Description of Artificial Sequence: Synthetic oligonucleotide"
ccacaagauuac

SEQ ID NO: 2274 - RNA, 12 nt, Artificial Sequence
  source: /note="Description of Artificial Sequence: Synthetic oligonucleotide"
cacaagauuaca

SEQ ID NO: 2275 - RNA, 12 nt, Artificial Sequence
  source: /note="Description of Artificial Sequence: Synthetic oligonucleotide"
acaagauuacaa

SEQ ID NO: 2276 - RNA, 12 nt, Artificial Sequence
  source: /note="Description of Artificial Sequence: Synthetic oligonucleotide"
agauuacaagaa

SEQ ID NO: 2277 - RNA, 12 nt, Artificial Sequence
  source: /note="Description of Artificial Sequence: Synthetic oligonucleotide"
caagaaacggcu

SEQ ID NO: 2278 - RNA, 12 nt, Artificial Sequence
  source: /note="Description of Artificial Sequence: Synthetic oligonucleotide"
aagaaacggcuu

SEQ ID NO: 2279 - RNA, 12 nt, Artificial Sequence
  source: /note="Description of Artificial Sequence: Synthetic oligonucleotide"
accagcucucuc

SEQ ID NO: 2280 - RNA, 12 nt, Artificial Sequence
  source: /note="Description of Artificial Sequence: Synthetic oligonucleotide"
ccagcucucucu

SEQ ID NO: 2281 - RNA, 12 nt, Artificial Sequence
  source: /note="Description of Artificial Sequence: Synthetic oligonucleotide"
cagcucucucuu

SEQ ID NO: 2282 - RNA, 12 nt, Artificial Sequence
  source: /note="Description of Artificial Sequence: Synthetic oligonucleotide"
gccaauggcuug

SEQ ID NO: 2283 - RNA, 12 nt, Artificial Sequence
  source: /note="Description of Artificial Sequence: Synthetic oligonucleotide"
ccaauggcuugg

SEQ ID NO: 2284 - RNA, 12 nt, Artificial Sequence
  source: /note="Description of Artificial Sequence: Synthetic oligonucleotide"
caauggcuugga

SEQ ID NO: 2285 - RNA, 12 nt, Artificial Sequence
  source: /note="Description of Artificial Sequence: Synthetic oligonucleotide"
aauggcuuggaa

SEQ ID NO: 2286 - RNA, 12 nt, Artificial Sequence
  source: /note="Description of Artificial Sequence: Synthetic oligonucleotide"
auggcuuggaau

SEQ ID NO: 2287 - RNA, 12 nt, Artificial Sequence
  source: /note="Description of Artificial Sequence: Synthetic oligonucleotide"
uggcuuggaaug

SEQ ID NO: 2288 - RNA, 12 nt, Artificial Sequence
  source: /note="Description of Artificial Sequence: Synthetic oligonucleotide"
ggcuuggaauga

SEQ ID NO: 2289 - RNA, 12 nt, Artificial Sequence
  source: /note="Description of Artificial Sequence: Synthetic oligonucleotide"
gcuuggaaugag

SEQ ID NO: 2290 - RNA, 12 nt, Artificial Sequence
  source: /note="Description of Artificial Sequence: Synthetic oligonucleotide"
cuuggaaugaga

SEQ ID NO: 2291 - RNA, 12 nt, Artificial Sequence
  source: /note="Description of Artificial Sequence: Synthetic oligonucleotide"
uuggaaugagac

SEQ ID NO: 2292 - RNA, 12 nt, Artificial Sequence
  source: /note="Description of Artificial Sequence: Synthetic oligonucleotide"
uggaaugagacu

SEQ ID NO: 2293 - RNA, 12 nt, Artificial Sequence
  source: /note="Description of Artificial Sequence: Synthetic oligonucleotide"
ugcccagggaga

SEQ ID NO: 2294 - RNA, 12 nt, Artificial Sequence
  source: /note="Description of Artificial Sequence: Synthetic oligonucleotide"
gcccagggagaa

SEQ ID NO: 2295 - RNA, 12 nt, Artificial Sequence
  source: /note="Description of Artificial Sequence: Synthetic oligonucleotide"
cagggagaaccc

SEQ ID NO: 2296 - RNA, 12 nt, Artificial Sequence
  source: /note="Description of Artificial Sequence: Synthetic oligonucleotide"
agggagaacccc

SEQ ID NO: 2297 - RNA, 12 nt, Artificial Sequence
  source: /note="Description of Artificial Sequence: Synthetic oligonucleotide"
gggagaaccccu

SEQ ID NO: 2298 - RNA, 12 nt, Artificial Sequence
  source: /note="Description of Artificial Sequence: Synthetic oligonucleotide"
ggagaaccccuu

SEQ ID NO: 2299 - RNA, 12 nt, Artificial Sequence
  source: /note="Description of Artificial Sequence: Synthetic oligonucleotide"
gagaaccccuug

SEQ ID NO: 2300 - RNA, 12 nt, Artificial Sequence
  source: /note="Description of Artificial Sequence: Synthetic oligonucleotide"
agaaccccuugg

SEQ ID NO: 2301 - RNA, 12 nt, Artificial Sequence
  source: /note="Description of Artificial Sequence: Synthetic oligonucleotide"
gaaccccuugga

SEQ ID NO: 2302 - RNA, 12 nt, Artificial Sequence
  source: /note="Description of Artificial Sequence: Synthetic oligonucleotide"
aaccccuuggau

SEQ ID NO: 2303 - RNA, 12 nt, Artificial Sequence
  source: /note="Description of Artificial Sequence: Synthetic oligonucleotide"
ccuuggauaucg

SEQ ID NO: 2304 - RNA, 12 nt, Artificial Sequence
  source: /note="Description of Artificial Sequence: Synthetic oligonucleotide"
cuuggauaucgc

SEQ ID NO: 2305 - RNA, 12 nt, Artificial Sequence
  source: /note="Description of Artificial Sequence: Synthetic oligonucleotide"
uuggauaucgcc

SEQ ID NO: 2306 - RNA, 12 nt, Artificial Sequence
  source: /note="Description of Artificial Sequence: Synthetic oligonucleotide"
uggauaucgcca

SEQ ID NO: 2307 - RNA, 12 nt, Artificial Sequence
  source: /note="Description of Artificial Sequence: Synthetic oligonucleotide"
ggauaucgccag

SEQ ID NO: 2308 - RNA, 12 nt, Artificial Sequence
  source: /note="Description of Artificial Sequence: Synthetic oligonucleotide"
gauaucgccagg

SEQ ID NO: 2309 - RNA, 12 nt, Artificial Sequence
  source: /note="Description of Artificial Sequence: Synthetic oligonucleotide"
auaucgccagga

SEQ ID NO: 2310 - RNA, 12 nt, Artificial Sequence
  source: /note="Description of Artificial Sequence: Synthetic oligonucleotide"
uaucgccaggau

SEQ ID NO: 2311 - RNA, 12 nt, Artificial Sequence
  source: /note="Description of Artificial Sequence: Synthetic oligonucleotide"
aucgccaggaug

SEQ ID NO: 2312 - RNA, 12 nt, Artificial Sequence
  source: /note="Description of Artificial Sequence: Synthetic oligonucleotide"
ucgccaggauga

SEQ ID NO: 2313 - RNA, 12 nt, Artificial Sequence
  source: /note="Description of Artificial Sequence: Synthetic oligonucleotide"
cgccaggaugau

SEQ ID NO: 2314 - RNA, 12 nt, Artificial Sequence
  source: /note="Description of Artificial Sequence: Synthetic oligonucleotide"
gccaggaugauc

SEQ ID NO: 2315 - RNA, 12 nt, Artificial Sequence
  source: /note="Description of Artificial Sequence: Synthetic oligonucleotide"
ccaggaugaucc

SEQ ID NO: 2316 - RNA, 12 nt, Artificial Sequence
  source: /note="Description of Artificial Sequence: Synthetic oligonucleotide"
caggaugauccu

SEQ ID NO: 2317 - RNA, 12 nt, Artificial Sequence
  source: /note="Description of Artificial Sequence: Synthetic oligonucleotide"
aggaugauccua

SEQ ID NO: 2318 - RNA, 12 nt, Artificial Sequence
  source: /note="Description of Artificial Sequence: Synthetic oligonucleotide"
ggaugauccuag

SEQ ID NO: 2319 - RNA, 12 nt, Artificial Sequence
  source: /note="Description of Artificial Sequence: Synthetic oligonucleotide"
gaugauccuagc

SEQ ID NO: 2320 - RNA, 12 nt, Artificial Sequence
  source: /note="Description of Artificial Sequence: Synthetic oligonucleotide"
augauccuagcu

SEQ ID NO: 2321 - RNA, 12 nt, Artificial Sequence
  source: /note="Description of Artificial Sequence: Synthetic oligonucleotide"
ugauccuagcua

SEQ ID NO: 2322 - RNA, 12 nt, Artificial Sequence
  source: /note="Description of Artificial Sequence: Synthetic oligonucleotide"
gauccuagcuau

SEQ ID NO: 2323 - RNA, 12 nt, Artificial Sequence
  source: /note="Description of Artificial Sequence: Synthetic oligonucleotide"
auccuagcuauc

SEQ ID NO: 2324 - RNA, 12 nt, Artificial Sequence
  source: /note="Description of Artificial Sequence: Synthetic oligonucleotide"
uccuagcuaucg

SEQ ID NO: 2325 - RNA, 12 nt, Artificial Sequence
  source: /note="Description of Artificial Sequence: Synthetic oligonucleotide"
ccuagcuaucgu

SEQ ID NO: 2326 - RNA, 12 nt, Artificial Sequence
  source: /note="Description of Artificial Sequence: Synthetic oligonucleotide"
cuagcuaucguu

SEQ ID NO: 2327 - RNA, 12 nt, Artificial Sequence
  source: /note="Description of Artificial Sequence: Synthetic oligonucleotide"
uagcuaucguuc

SEQ ID NO: 2328 - RNA, 12 nt, Artificial Sequence
  source: /note="Description of Artificial Sequence: Synthetic oligonucleotide"
agcuaucguucu

SEQ ID NO: 2329 - RNA, 12 nt, Artificial Sequence
  source: /note="Description of Artificial Sequence: Synthetic oligonucleotide"
gcuaucguucuu

SEQ ID NO: 2330 - RNA, 12 nt, Artificial Sequence
  source: /note="Description of Artificial Sequence: Synthetic oligonucleotide"
cuaucguucuuu

SEQ ID NO: 2331 - RNA, 12 nt, Artificial Sequence
  source: /note="Description of Artificial Sequence: Synthetic oligonucleotide"
ucuuuucacucu

SEQ ID NO: 2332 - RNA, 12 nt, Artificial Sequence
  source: /note="Description of Artificial Sequence: Synthetic oligonucleotide"
cuuuucacucug

SEQ ID NO: 2333 - RNA, 12 nt, Artificial Sequence
  source: /note="Description of Artificial Sequence: Synthetic oligonucleotide"
uuuucacucugg

SEQ ID NO: 2334 - RNA, 12 nt, Artificial Sequence
  source: /note="Description of Artificial Sequence: Synthetic oligonucleotide"
uuucacucuggu

SEQ ID NO: 2335 - RNA, 12 nt, Artificial Sequence
  source: /note="Description of Artificial Sequence: Synthetic oligonucleotide"
uucacucuggug

SEQ ID NO: 2336 - RNA, 12 nt, Artificial Sequence
  source: /note="Description of Artificial Sequence: Synthetic oligonucleotide"
ucacucuggugg

SEQ ID NO: 2337 - RNA, 12 nt, Artificial Sequence
  source: /note="Description of Artificial Sequence: Synthetic oligonucleotide"
cacucuggugga

SEQ ID NO: 2338 - RNA, 12 nt, Artificial Sequence
  source: /note="Description of Artificial Sequence: Synthetic oligonucleotide"
acucugguggau

SEQ ID NO: 2339 - RNA, 12 nt, Artificial Sequence
  source: /note="Description of Artificial Sequence: Synthetic oligonucleotide"
cucugguggaua

SEQ ID NO: 2340 - RNA, 12 nt, Artificial Sequence
  source: /note="Description of Artificial Sequence: Synthetic oligonucleotide"
gauauggccagg

SEQ ID NO: 2341 - RNA, 12 nt, Artificial Sequence
  source: /note="Description of Artificial Sequence: Synthetic oligonucleotide"
auauggccagga

SEQ ID NO: 2342 - RNA, 12 nt, Artificial Sequence
  source: /note="Description of Artificial Sequence: Synthetic oligonucleotide"
uauggccaggau

SEQ ID NO: 2343 - RNA, 12 nt, Artificial Sequence
  source: /note="Description of Artificial Sequence: Synthetic oligonucleotide"
ggccaggaugcc

SEQ ID NO: 2344 - RNA, 12 nt, Artificial Sequence
  source: /note="Description of Artificial Sequence: Synthetic oligonucleotide"
gccaggaugccu

SEQ ID NO: 2345 - RNA, 12 nt, Artificial Sequence
  source: /note="Description of Artificial Sequence: Synthetic oligonucleotide"
ccaggaugccuu

SEQ ID NO: 2346 - RNA, 12 nt, Artificial Sequence
  source: /note="Description of Artificial Sequence: Synthetic oligonucleotide"
uggguauggacc

SEQ ID NO: 2347 - RNA, 12 nt, Artificial Sequence
  source: /note="Description of Artificial Sequence: Synthetic oligonucleotide"
ggguauggaccc

SEQ ID NO: 2348 - RNA, 12 nt, Artificial Sequence
  source: /note="Description of Artificial Sequence: Synthetic oligonucleotide"
gguauggacccc

SEQ ID NO: 2349 - RNA, 12 nt, Artificial Sequence
  source: /note="Description of Artificial Sequence: Synthetic oligonucleotide"
guauggacccca

SEQ ID NO: 2350 - RNA, 12 nt, Artificial Sequence
  source: /note="Description of Artificial Sequence: Synthetic oligonucleotide"
uauggaccccau

SEQ ID NO: 2351 - RNA, 12 nt, Artificial Sequence
  source: /note="Description of Artificial Sequence: Synthetic oligonucleotide"
auggaccccaug

SEQ ID NO: 2352 - RNA, 12 nt, Artificial Sequence
  source: /note="Description of Artificial Sequence: Synthetic oligonucleotide"
uggaccccauga

SEQ ID NO: 2353 - RNA, 12 nt, Artificial Sequence
  source: /note="Description of Artificial Sequence: Synthetic oligonucleotide"
ggaccccaugau

SEQ ID NO: 2354 - RNA, 12 nt, Artificial Sequence
  source: /note="Description of Artificial Sequence: Synthetic oligonucleotide"
gaccccaugaug

SEQ ID NO: 2355 - RNA, 12 nt, Artificial Sequence
  source: /note="Description of Artificial Sequence: Synthetic oligonucleotide"
accccaugaugg

SEQ ID NO: 2356 - RNA, 12 nt, Artificial Sequence
  source: /note="Description of Artificial Sequence: Synthetic oligonucleotide"
ccccaugaugga

SEQ ID NO: 2357 - RNA, 12 nt, Artificial Sequence
  source: /note="Description of Artificial Sequence: Synthetic oligonucleotide"
cccaugauggaa

SEQ ID NO: 2358 - RNA, 12 nt, Artificial Sequence
  source: /note="Description of Artificial Sequence: Synthetic oligonucleotide"
ccaugauggaac

SEQ ID NO: 2359 - RNA, 12 nt, Artificial Sequence
  source: /note="Description of Artificial Sequence: Synthetic oligonucleotide"
caugauggaaca

SEQ ID NO: 2360 - RNA, 12 nt, Artificial Sequence
  source: /note="Description of Artificial Sequence: Synthetic oligonucleotide"
augauggaacau

SEQ ID NO: 2361 - RNA, 12 nt, Artificial Sequence
  source: /note="Description of Artificial Sequence: Synthetic oligonucleotide"
ccacccuggugc

SEQ ID NO: 2362 - RNA, 12 nt, Artificial Sequence
  source: /note="Description of Artificial Sequence: Synthetic oligonucleotide"
cacccuggugcu

SEQ ID NO: 2363 - RNA, 12 nt, Artificial Sequence
  source: /note="Description of Artificial Sequence: Synthetic oligonucleotide"
acccuggugcug

SEQ ID NO: 2364 - RNA, 12 nt, Artificial Sequence
  source: /note="Description of Artificial Sequence: Synthetic oligonucleotide"
cccuggugcuga

SEQ ID NO: 2365 - RNA, 12 nt, Artificial Sequence
  source: /note="Description of Artificial Sequence: Synthetic oligonucleotide"
ccuggugcugac

SEQ ID NO: 2366 - RNA, 12 nt, Artificial Sequence
  source: /note="Description of Artificial Sequence: Synthetic oligonucleotide"
cuggugcugacu

SEQ ID NO: 2367 - RNA, 12 nt, Artificial Sequence
  source: /note="Description of Artificial Sequence: Synthetic oligonucleotide"
uggugcugacua

SEQ ID NO: 2368 - RNA, 12 nt, Artificial Sequence
  source: /note="Description of Artificial Sequence: Synthetic oligonucleotide"
ggugcugacuau

SEQ ID NO: 2369 - RNA, 12 nt, Artificial Sequence
  source: /note="Description of Artificial Sequence: Synthetic oligonucleotide"
gugcugacuauc

SEQ ID NO: 2370 - RNA, 12 nt, Artificial Sequence
  source: /note="Description of Artificial Sequence: Synthetic oligonucleotide"
ugcugacuaucc

SEQ ID NO: 2371 - RNA, 12 nt, Artificial Sequence
  source: /note="Description of Artificial Sequence: Synthetic oligonucleotide"
gcugacuaucca

SEQ ID NO: 2372 - RNA, 12 nt, Artificial Sequence
  source: /note="Description of Artificial Sequence: Synthetic oligonucleotide"
cugacuauccag

SEQ ID NO: 2373 - RNA, 12 nt, Artificial Sequence
  source: /note="Description of Artificial Sequence: Synthetic oligonucleotide"
ugacuauccagu

SEQ ID NO: 2374 - RNA, 12 nt, Artificial Sequence
  source: /note="Description of Artificial Sequence: Synthetic oligonucleotide"
gacuauccaguu

SEQ ID NO: 2375 - RNA, 12 nt, Artificial Sequence
  source: /note="Description of Artificial Sequence: Synthetic oligonucleotide"
acuauccaguug

SEQ ID NO: 2376 - RNA, 12 nt, Artificial Sequence
  source: /note="Description of Artificial Sequence: Synthetic oligonucleotide"
cuauccaguuga

SEQ ID NO: 2377 - RNA, 12 nt, Artificial Sequence
  source: /note="Description of Artificial Sequence: Synthetic oligonucleotide"
uauccaguugau

SEQ ID NO: 2378 - RNA, 12 nt, Artificial Sequence
  source: /note="Description of Artificial Sequence: Synthetic oligonucleotide"
auccaguugaug

SEQ ID NO: 2379 - RNA, 12 nt, Artificial Sequence
  source: /note="Description of Artificial Sequence: Synthetic oligonucleotide"
uccaguugaugg

SEQ ID NO: 2380 - RNA, 12 nt, Artificial Sequence
  source: /note="Description of Artificial Sequence: Synthetic oligonucleotide"
ccaguugauggg

SEQ ID NO: 2381 - RNA, 12 nt, Artificial Sequence
  source: /note="Description of Artificial Sequence: Synthetic oligonucleotide"
caguugaugggc

SEQ ID NO: 2382 - RNA, 12 nt, Artificial Sequence
  source: /note="Description of Artificial Sequence: Synthetic oligonucleotide"
aguugaugggcu

SEQ ID NO: 2383 - RNA, 12 nt, Artificial Sequence
  source: /note="Description of Artificial Sequence: Synthetic oligonucleotide"
guugaugggcug

SEQ ID NO: 2384 - RNA, 12 nt, Artificial Sequence
  source: /note="Description of Artificial Sequence: Synthetic oligonucleotide"
ccaggaccucau

SEQ ID NO: 2385 - RNA, 12 nt, Artificial Sequence
  source: /note="Description of Artificial Sequence: Synthetic oligonucleotide"
caggaccucaug

SEQ ID NO: 2386 - RNA, 12 nt, Artificial Sequence
  source: /note="Description of Artificial Sequence: Synthetic oligonucleotide"
aggaccucaugg

SEQ ID NO: 2387 - RNA, 12 nt, Artificial Sequence
  source: /note="Description of Artificial Sequence: Synthetic oligonucleotide"
ggaccucaugga

SEQ ID NO: 2388 - RNA, 12 nt, Artificial Sequence
  source: /note="Description of Artificial Sequence: Synthetic oligonucleotide"
gaccucauggau

SEQ ID NO: 2389 - RNA, 12 nt, Artificial Sequence
  source: /note="Description of Artificial Sequence: Synthetic oligonucleotide"
caaucagcuggc

SEQ ID NO: 2390 - RNA, 12 nt, Artificial Sequence
  source: /note="Description of Artificial Sequence: Synthetic oligonucleotide"
aaucagcuggcc

SEQ ID NO: 2391 - RNA, 12 nt, Artificial Sequence
  source: /note="Description of Artificial Sequence: Synthetic oligonucleotide"
aucagcuggccu

SEQ ID NO: 2392 - RNA, 12 nt, Artificial Sequence
  source: /note="Description of Artificial Sequence: Synthetic oligonucleotide"
ucagcuggccug

SEQ ID NO: 2393 - RNA, 12 nt, Artificial Sequence
  source: /note="Description of Artificial Sequence: Synthetic oligonucleotide"
cagcuggccugg

SEQ ID NO: 2394 - RNA, 12 nt, Artificial Sequence
  source: /note="Description of Artificial Sequence: Synthetic oligonucleotide"
agcuggccuggu

SEQ ID NO: 2395 - RNA, 12 nt, Artificial Sequence
  source: /note="Description of Artificial Sequence: Synthetic oligonucleotide"
gcuggccugguu

SEQ ID NO: 2396 - RNA, 12 nt, Artificial Sequence
  source: /note="Description of Artificial Sequence: Synthetic oligonucleotide"
cuggccugguuu

SEQ ID NO: 2397 - RNA, 12 nt, Artificial Sequence
  source: /note="Description of Artificial Sequence: Synthetic oligonucleotide"
uggccugguuug

SEQ ID NO: 2398 - RNA, 12 nt, Artificial Sequence
  source: /note="Description of Artificial Sequence: Synthetic oligonucleotide"
ggccugguuuga

SEQ ID NO: 2399 - RNA, 12 nt, Artificial Sequence
  source: /note="Description of Artificial Sequence: Synthetic oligonucleotide"
gccugguuugau

SEQ ID NO: 2400 - RNA, 12 nt, Artificial Sequence
  source: /note="Description of Artificial Sequence: Synthetic oligonucleotide"
ccugguuugaua

SEQ ID NO: 2401 - RNA, 12 nt, Artificial Sequence
  source: /note="Description of Artificial Sequence: Synthetic oligonucleotide"
cugguuugauac

SEQ ID NO: 2402 - RNA, 12 nt, Artificial Sequence
  source: /note="Description of Artificial Sequence: Synthetic oligonucleotide"
ugguuugauacu

SEQ ID NO: 2403 - RNA, 12 nt, Artificial Sequence
  source: /note="Description of Artificial Sequence: Synthetic oligonucleotide"
gguuugauacug

SEQ ID NO: 2404 - RNA, 12 nt, Artificial Sequence
  source: /note="Description of Artificial Sequence: Synthetic oligonucleotide"
guuugauacuga

SEQ ID NO: 2405 - RNA, 12 nt, Artificial Sequence
  source: /note="Description of Artificial Sequence: Synthetic oligonucleotide"
uuugauacugac

SEQ ID NO: 2406 - RNA, 12 nt, Artificial Sequence
  source: /note="Description of Artificial Sequence: Synthetic oligonucleotide"
uugauacugacc

SEQ ID NO: 2407 - RNA, 12 nt, Artificial Sequence
  source: /note="Description of Artificial Sequence: Synthetic oligonucleotide"
ugauacugaccu

SEQ ID NO: 2408 - RNA, 12 nt, Artificial Sequence
  source: /note="Description of Artificial Sequence: Synthetic oligonucleotide"
gauacugaccug

SEQ ID NO: 2409 - RNA, 12 nt, Artificial Sequence
  source: /note="Description of Artificial Sequence: Synthetic oligonucleotide"
auacugaccugu

SEQ ID NO: 2410 - RNA, 12 nt, Artificial Sequence
  source: /note="Description of Artificial Sequence: Synthetic oligonucleotide"
uacugaccugua

SEQ ID NO: 2411 - RNA, 12 nt, Artificial Sequence
  source: /note="Description of Artificial Sequence: Synthetic oligonucleotide"
acugaccuguaa

SEQ ID NO: 2412 - RNA, 12 nt, Artificial Sequence
  source: /note="Description of Artificial Sequence: Synthetic oligonucleotide"
cugaccuguaaa

SEQ ID NO: 2413 - RNA, 12 nt, Artificial Sequence
  source: /note="Description of Artificial Sequence: Synthetic oligonucleotide"
ugaccuguaaau

SEQ ID NO: 2414 - RNA, 12 nt, Artificial Sequence
  source: /note="Description of Artificial Sequence: Synthetic oligonucleotide"
gaccuguaaauc

SEQ ID NO: 2415 - RNA, 12 nt, Artificial Sequence
  source: /note="Description of Artificial Sequence: Synthetic oligonucleotide"
accuguaaauca

SEQ ID NO: 2416 - RNA, 12 nt, Artificial Sequence
  source: /note="Description of Artificial Sequence: Synthetic oligonucleotide"
ccuguaaaucau

SEQ ID NO: 2417 - RNA, 12 nt, Artificial Sequence
  source: /note="Description of Artificial Sequence: Synthetic oligonucleotide"
cuguaaaucauc

SEQ ID NO: 2418 - RNA, 12 nt, Artificial Sequence
  source: /note="Description of Artificial Sequence: Synthetic oligonucleotide"
uguaaaucaucc

SEQ ID NO: 2419 - RNA, 12 nt, Artificial Sequence
  source: /note="Description of Artificial Sequence: Synthetic oligonucleotide"
guaaaucauccu

SEQ ID NO: 2420 - RNA, 12 nt, Artificial Sequence
  source: /note="Description of Artificial Sequence: Synthetic oligonucleotide"
uaaaucauccuu

SEQ ID NO: 2421 - RNA, 12 nt, Artificial Sequence
  source: /note="Description of Artificial Sequence: Synthetic oligonucleotide"
aaaucauccuuu

SEQ ID NO: 2422 - RNA, 12 nt, Artificial Sequence
  source: /note="Description of Artificial Sequence: Synthetic oligonucleotide"
guaacaauacaa

SEQ ID NO: 2423 - RNA, 12 nt, Artificial Sequence
  source: /note="Description of Artificial Sequence: Synthetic oligonucleotide"
uaacaauacaaa

SEQ ID NO: 2424 - RNA, 12 nt, Artificial Sequence
  source: /note="Description of Artificial Sequence: Synthetic oligonucleotide"
aacaauacaaau

SEQ ID NO: 2425 - RNA, 12 nt, Artificial Sequence
  source: /note="Description of Artificial Sequence: Synthetic oligonucleotide"
acaauacaaaug

SEQ ID NO: 2426 - RNA, 12 nt, Artificial Sequence
  source: /note="Description of Artificial Sequence: Synthetic oligonucleotide"
caauacaaaugg

SEQ ID NO: 2427 - RNA, 12 nt, Artificial Sequence
  source: /note="Description of Artificial Sequence: Synthetic oligonucleotide"
aauacaaaugga

SEQ ID NO: 2428 - RNA, 12 nt, Artificial Sequence
  source: /note="Description of Artificial Sequence: Synthetic oligonucleotide"
auacaaauggau

SEQ ID NO: 2429 - RNA, 12 nt, Artificial Sequence
  source: /note="Description of Artificial Sequence: Synthetic oligonucleotide"
uacaaauggauu

SEQ ID NO: 2430 - RNA, 12 nt, Artificial Sequence
  source: /note="Description of Artificial Sequence: Synthetic oligonucleotide"
acaaauggauuu

SEQ ID NO: 2431 - RNA, 12 nt, Artificial Sequence
  source: /note="Description of Artificial Sequence: Synthetic oligonucleotide"
caaauggauuuu

SEQ ID NO: 2432 - RNA, 12 nt, Artificial Sequence
  source: /note="Description of Artificial Sequence: Synthetic oligonucleotide"
aaauggauuuug

SEQ ID NO: 2433 - RNA, 12 nt, Artificial Sequence
  source: /note="Description of Artificial Sequence: Synthetic oligonucleotide"
ugggagugacuc

SEQ ID NO: 2434 - RNA, 12 nt, Artificial Sequence
  source: /note="Description of Artificial Sequence: Synthetic oligonucleotide"
gggagugacuca

SEQ ID NO: 2435 - RNA, 12 nt, Artificial Sequence
  source: /note="Description of Artificial Sequence: Synthetic oligonucleotide"
ggagugacucaa

SEQ ID NO: 2436 - RNA, 12 nt, Artificial Sequence
  source: /note="Description of Artificial Sequence: Synthetic oligonucleotide"
gagugacucaag

SEQ ID NO: 2437 - RNA, 12 nt, Artificial Sequence
  source: /note="Description of Artificial Sequence: Synthetic oligonucleotide"
agugacucaaga

SEQ ID NO: 2438 - RNA, 12 nt, Artificial Sequence
  source: /note="Description of Artificial Sequence: Synthetic oligonucleotide"
gugacucaagaa

SEQ ID NO: 2439 - RNA, 12 nt, Artificial Sequence
  source: /note="Description of Artificial Sequence: Synthetic oligonucleotide"
ugacucaagaag

SEQ ID NO: 2440 - RNA, 12 nt, Artificial Sequence
  source: /note="Description of Artificial Sequence: Synthetic oligonucleotide"
aagugaagaaug

SEQ ID NO: 2441 - RNA, 12 nt, Artificial Sequence
  source: /note="Description of Artificial Sequence: Synthetic oligonucleotide"
agugaagaaugc

SEQ ID NO: 2442 - RNA, 12 nt, Artificial Sequence
  source: /note="Description of Artificial Sequence: Synthetic oligonucleotide"
gugaagaaugca

SEQ ID NO: 2443 - RNA, 12 nt, Artificial Sequence
  source: /note="Description of Artificial Sequence: Synthetic oligonucleotide"
ugaagaaugcac

SEQ ID NO: 2444 - RNA, 12 nt, Artificial Sequence
  source: /note="Description of Artificial Sequence: Synthetic oligonucleotide"
gaagaaugcaca

SEQ ID NO: 2445 - RNA, 12 nt, Artificial Sequence
  source: /note="Description of Artificial Sequence: Synthetic oligonucleotide"
aagaaugcacaa

SEQ ID NO: 2446 - RNA, 12 nt, Artificial Sequence
  source: /note="Description of Artificial Sequence: Synthetic oligonucleotide"
agaaugcacaag

SEQ ID NO: 2447 - RNA, 12 nt, Artificial Sequence
  source: /note="Description of Artificial Sequence: Synthetic oligonucleotide"
gaaugcacaaga

SEQ ID NO: 2448 - RNA, 12 nt, Artificial Sequence
  source: /note="Description of Artificial Sequence: Synthetic oligonucleotide"
auggaucacaag

SEQ ID NO: 2449 - RNA, 12 nt, Artificial Sequence
  source: /note="Description of Artificial Sequence: Synthetic oligonucleotide"
uggaucacaaga

SEQ ID NO: 2450 - RNA, 12 nt, Artificial Sequence
  source: /note="Description of Artificial Sequence: Synthetic oligonucleotide"
ggaucacaagau

SEQ ID NO: 2451 - RNA, 12 nt, Artificial Sequence
  source: /note="Description of Artificial Sequence: Synthetic oligonucleotide"
gaucacaagaug

SEQ ID NO: 2452 - RNA, 12 nt, Artificial Sequence
  source: /note="Description of Artificial Sequence: Synthetic oligonucleotide"
aucacaagaugg

SEQ ID NO: 2453 - RNA, 12 nt, Artificial Sequence
  source: /note="Description of Artificial Sequence: Synthetic oligonucleotide"
ucacaagaugga

SEQ ID NO: 2454 - RNA, 12 nt, Artificial Sequence
  source: /note="Description of Artificial Sequence: Synthetic oligonucleotide"
cacaagauggaa

SEQ ID NO: 2455 - RNA, 12 nt, Artificial Sequence
  source: /note="Description of Artificial Sequence: Synthetic oligonucleotide"
acaagauggaau

SEQ ID NO: 2456 - RNA, 12 nt, Artificial Sequence
  source: /note="Description of Artificial Sequence: Synthetic oligonucleotide"
caagauggaauu

SEQ ID NO: 2457 - RNA, 12 nt, Artificial Sequence
  source: /note="Description of Artificial Sequence: Synthetic oligonucleotide"
aagauggaauuu

SEQ ID NO: 2458 - RNA, 12 nt, Artificial Sequence
  source: /note="Description of Artificial Sequence: Synthetic oligonucleotide"
agauggaauuua

SEQ ID NO: 2459 - RNA, 12 nt, Artificial Sequence
  source: /note="Description of Artificial Sequence: Synthetic oligonucleotide"
gauggaauuuau

SEQ ID NO: 2460 - RNA, 12 nt, Artificial Sequence
  source: /note="Description of Artificial Sequence: Synthetic oligonucleotide"
auggaauuuauc

SEQ ID NO: 2461 - RNA, 12 nt, Artificial Sequence
  source: /note="Description of Artificial Sequence: Synthetic oligonucleotide"
uggaauuuauca

SEQ ID NO: 2462 - RNA, 12 nt, Artificial Sequence
  source: /note="Description of Artificial Sequence: Synthetic oligonucleotide"
ggaauuuaucaa

SEQ ID NO: 2463 - RNA, 12 nt, Artificial Sequence
  source: /note="Description of Artificial Sequence: Synthetic oligonucleotide"
gaauuuaucaaa

SEQ ID NO: 2464 - RNA, 12 nt, Artificial Sequence
  source: /note="Description of Artificial Sequence: Synthetic oligonucleotide"
aauuuaucaaac

SEQ ID NO: 2465 - RNA, 12 nt, Artificial Sequence
  source: /note="Description of Artificial Sequence: Synthetic oligonucleotide"
auuuaucaaacc

SEQ ID NO: 2466 - RNA, 12 nt, Artificial Sequence
  source: /note="Description of Artificial Sequence: Synthetic oligonucleotide"
uuuaucaaaccc

SEQ ID NO: 2467 - RNA, 12 nt, Artificial Sequence
  source: /note="Description of Artificial Sequence: Synthetic oligonucleotide"
uuaucaaacccu

SEQ ID NO: 2468 - RNA, 12 nt, Artificial Sequence
  source: /note="Description of Artificial Sequence: Synthetic oligonucleotide"
uaucaaacccua

SEQ ID NO: 2469 - RNA, 12 nt, Artificial Sequence
  source: /note="Description of Artificial Sequence: Synthetic oligonucleotide"
aucaaacccuag

SEQ ID NO: 2470 - RNA, 12 nt, Artificial Sequence
  source: /note="Description of Artificial Sequence: Synthetic oligonucleotide"
ucaaacccuagc

SEQ ID NO: 2471 - RNA, 12 nt, Artificial Sequence
  source: /note="Description of Artificial Sequence: Synthetic oligonucleotide"
caaacccuagcc

SEQ ID NO: 2472 - RNA, 12 nt, Artificial Sequence
  source: /note="Description of Artificial Sequence: Synthetic oligonucleotide"
aaacccuagccu

SEQ ID NO: 2473 - RNA, 12 nt, Artificial Sequence
  source: /note="Description of Artificial Sequence: Synthetic oligonucleotide"
aacccuagccuu

SEQ ID NO: 2474 - RNA, 12 nt, Artificial Sequence
  source: /note="Description of Artificial Sequence: Synthetic oligonucleotide"
acccuagccuug

SEQ ID NO: 2475 - RNA, 12 nt, Artificial Sequence
  source: /note="Description of Artificial Sequence: Synthetic oligonucleotide"
cccuagccuugc

SEQ ID NO: 2476 - RNA, 12 nt, Artificial Sequence
  source: /note="Description of Artificial Sequence: Synthetic oligonucleotide"
ccuagccuugcu

SEQ ID NO: 2477 - RNA, 12 nt, Artificial Sequence
  source: /note="Description of Artificial Sequence: Synthetic oligonucleotide"
cuagccuugcuu

SEQ ID NO: 2478 - RNA, 12 nt, Artificial Sequence
  source: /note="Description of Artificial Sequence: Synthetic oligonucleotide"
uagccuugcuug

SEQ ID NO: 2479 - RNA, 12 nt, Artificial Sequence
  source: /note="Description of Artificial Sequence: Synthetic oligonucleotide"
agccuugcuugu

SEQ ID NO: 2480 - RNA, 12 nt, Artificial Sequence
  source: /note="Description of Artificial Sequence: Synthetic oligonucleotide"
gccuugcuuguu

SEQ ID NO: 2481 - RNA, 12 nt, Artificial Sequence
  source: /note="Description of Artificial Sequence: Synthetic oligonucleotide"
ccuugcuuguua

SEQ ID NO: 2482 - RNA, 12 nt, Artificial Sequence
  source: /note="Description of Artificial Sequence: Synthetic oligonucleotide"
cuugcuuguuaa

SEQ ID NO: 2483 - RNA, 12 nt, Artificial Sequence
  source: /note="Description of Artificial Sequence: Synthetic oligonucleotide"
uugcuuguuaaa

SEQ ID NO: 2484 - RNA, 12 nt, Artificial Sequence
  source: /note="Description of Artificial Sequence: Synthetic oligonucleotide"
ugcuuguuaaau

SEQ ID NO: 2485 - RNA, 12 nt, Artificial Sequence
  source: /note="Description of Artificial Sequence: Synthetic oligonucleotide"
gcuuguuaaauu

SEQ ID NO: 2486 - RNA, 12 nt, Artificial Sequence
  source: /note="Description of Artificial Sequence: Synthetic oligonucleotide"
gaauaucuguaa

SEQ ID NO: 2487 - RNA, 12 nt, Artificial Sequence
  source: /note="Description of Artificial Sequence: Synthetic oligonucleotide"
aauaucuguaau

SEQ ID NO: 2488 - RNA, 12 nt, Artificial Sequence
  source: /note="Description of Artificial Sequence: Synthetic oligonucleotide"
auaucuguaaug

SEQ ID NO: 2489 - RNA, 12 nt, Artificial Sequence
  source: /note="Description of Artificial Sequence: Synthetic oligonucleotide"
uaucuguaaugg

SEQ ID NO: 2490 - RNA, 12 nt, Artificial Sequence
  source: /note="Description of Artificial Sequence: Synthetic oligonucleotide"
aucuguaauggu

SEQ ID NO: 2491 - RNA, 12 nt, Artificial Sequence
  source: /note="Description of Artificial Sequence: Synthetic oligonucleotide"
ucuguaauggua

SEQ ID NO: 2492 - RNA, 12 nt, Artificial Sequence
  source: /note="Description of Artificial Sequence: Synthetic oligonucleotide"
cuguaaugguac

SEQ ID NO: 2493 - RNA, 12 nt, Artificial Sequence
  source: /note="Description of Artificial Sequence: Synthetic oligonucleotide"
uguaaugguacu

SEQ ID NO: 2494 - RNA, 12 nt, Artificial Sequence
  source: /note="Description of Artificial Sequence: Synthetic oligonucleotide"
guaaugguacug

SEQ ID NO: 2495 - RNA, 12 nt, Artificial Sequence
  source: /note="Description of Artificial Sequence: Synthetic oligonucleotide"
uuuaagucucuc

SEQ ID NO: 2496 - RNA, 12 nt, Artificial Sequence
  source: /note="Description of Artificial Sequence: Synthetic oligonucleotide"
uuaagucucucg

SEQ ID NO: 2497 - RNA, 12 nt, Artificial Sequence
  source: /note="Description of Artificial Sequence: Synthetic oligonucleotide"
uaagucucucgu

SEQ ID NO: 2498 - RNA, 12 nt, Artificial Sequence
  source: /note="Description of Artificial Sequence: Synthetic oligonucleotide"
aagucucucgua

SEQ ID NO: 2499 - RNA, 12 nt, Artificial Sequence
  source: /note="Description of Artificial Sequence: Synthetic oligonucleotide"
agucucucguag

SEQ ID NO: 2500 - RNA, 12 nt, Artificial Sequence
  source: /note="Description of Artificial Sequence: Synthetic oligonucleotide"
gucucucguagu

SEQ ID NO: 2501 - RNA, 12 nt, Artificial Sequence
  source: /note="Description of Artificial Sequence: Synthetic oligonucleotide"
ucucucguagug

SEQ ID NO: 2502 - RNA, 12 nt, Artificial Sequence
  source: /note="Description of Artificial Sequence: Synthetic oligonucleotide"
cucucguagugu

SEQ ID NO: 2503 - RNA, 12 nt, Artificial Sequence
  source: /note="Description of Artificial Sequence: Synthetic oligonucleotide"
ucucguaguguu

SEQ ID NO: 2504 - RNA, 12 nt, Artificial Sequence
  source: /note="Description of Artificial Sequence: Synthetic oligonucleotide"
cucguaguguua

SEQ ID NO: 2505 - RNA, 12 nt, Artificial Sequence
  source: /note="Description of Artificial Sequence: Synthetic oligonucleotide"
ucguaguguuaa

SEQ ID NO: 2506 - RNA, 12 nt, Artificial Sequence
  source: /note="Description of Artificial Sequence: Synthetic oligonucleotide"
cguaguguuaag

SEQ ID NO: 2507 - RNA, 12 nt, Artificial Sequence
  source: /note="Description of Artificial Sequence: Synthetic oligonucleotide"
guaguguuaagu

SEQ ID NO: 2508 - RNA, 12 nt, Artificial Sequence
  source: /note="Description of Artificial Sequence: Synthetic oligonucleotide"
uaguguuaaguu

SEQ ID NO: 2509 - RNA, 12 nt, Artificial Sequence
  source: /note="Description of Artificial Sequence: Synthetic oligonucleotide"
aguguuaaguua

SEQ ID NO: 2510 - RNA, 12 nt, Artificial Sequence
  source: /note="Description of Artificial Sequence: Synthetic oligonucleotide"
guguuaaguuau

SEQ ID NO: 2511 - RNA, 12 nt, Artificial Sequence
  source: /note="Description of Artificial Sequence: Synthetic oligonucleotide"
uguuaaguuaua

SEQ ID NO: 2512 - RNA, 12 nt, Artificial Sequence
  source: /note="Description of Artificial Sequence: Synthetic oligonucleotide"
guuaaguuauag

SEQ ID NO: 2513 - RNA, 12 nt, Artificial Sequence
  source: /note="Description of Artificial Sequence: Synthetic oligonucleotide"
uuaaguuauagu

SEQ ID NO: 2514 - RNA, 12 nt, Artificial Sequence
  source: /note="Description of Artificial Sequence: Synthetic oligonucleotide"
uaaguuauagug

SEQ ID NO: 2515 - RNA, 12 nt, Artificial Sequence
  source: /note="Description of Artificial Sequence: Synthetic oligonucleotide"
aaguuauaguga

SEQ ID NO: 2516 - RNA, 12 nt, Artificial Sequence
  source: /note="Description of Artificial Sequence: Synthetic oligonucleotide"
aguuauagugaa

SEQ ID NO: 2517 - RNA, 12 nt, Artificial Sequence
  source: /note="Description of Artificial Sequence: Synthetic oligonucleotide"
uacagcaauuuc

SEQ ID NO: 2518 - RNA, 12 nt, Artificial Sequence
  source: /note="Description of Artificial Sequence: Synthetic oligonucleotide"
acagcaauuucu

SEQ ID NO: 2519 - RNA, 12 nt, Artificial Sequence
  source: /note="Description of Artificial Sequence: Synthetic oligonucleotide"
cagcaauuucua

SEQ ID NO: 2520 - RNA, 12 nt, Artificial Sequence
  source: /note="Description of Artificial Sequence: Synthetic oligonucleotide"
agcaauuucuaa

SEQ ID NO: 2521 - RNA, 12 nt, Artificial Sequence
  source: /note="Description of Artificial Sequence: Synthetic oligonucleotide"
gcaauuucuaau

SEQ ID NO: 2522 - RNA, 12 nt, Artificial Sequence
  source: /note="Description of Artificial Sequence: Synthetic oligonucleotide"
caauuucuaauu

SEQ ID NO: 2523 - RNA, 12 nt, Artificial Sequence
  source: /note="Description of Artificial Sequence: Synthetic oligonucleotide"
aauuucuaauuu

SEQ ID NO: 2524 - RNA, 12 nt, Artificial Sequence
  source: /note="Description of Artificial Sequence: Synthetic oligonucleotide"
uaaugguguaga

SEQ ID NO: 2525 - RNA, 12 nt, Artificial Sequence
  source: /note="Description of Artificial Sequence: Synthetic oligonucleotide"
aaugguguagaa

SEQ ID NO: 2526 - RNA, 12 nt, Artificial Sequence
  source: /note="Description of Artificial Sequence: Synthetic oligonucleotide"
augguguagaac

SEQ ID NO: 2527 - RNA, 12 nt, Artificial Sequence
  source: /note="Description of Artificial Sequence: Synthetic oligonucleotide"
ugguguagaaca

SEQ ID NO: 2528 - RNA, 12 nt, Artificial Sequence
  source: /note="Description of Artificial Sequence: Synthetic oligonucleotide"
gguguagaacac

SEQ ID NO: 2529 - RNA, 12 nt, Artificial Sequence
  source: /note="Description of Artificial Sequence: Synthetic oligonucleotide"
guguagaacacu

SEQ ID NO: 2530 - RNA, 12 nt, Artificial Sequence
  source: /note="Description of Artificial Sequence: Synthetic oligonucleotide"
uguagaacacua

SEQ ID NO: 2531 - RNA, 12 nt, Artificial Sequence
  source: /note="Description of Artificial Sequence: Synthetic oligonucleotide"
guagaacacuaa

SEQ ID NO: 2532 - RNA, 12 nt, Artificial Sequence
  source: /note="Description of Artificial Sequence: Synthetic oligonucleotide"
uagaacacuaau

SEQ ID NO: 2533 - RNA, 12 nt, Artificial Sequence
  source: /note="Description of Artificial Sequence: Synthetic oligonucleotide"
agaacacuaauu

SEQ ID NO: 2534 - RNA, 12 nt, Artificial Sequence
  source: /note="Description of Artificial Sequence: Synthetic oligonucleotide"
gaacacuaauuc

SEQ ID NO: 2535 - RNA, 12 nt, Artificial Sequence
  source: /note="Description of Artificial Sequence: Synthetic oligonucleotide"
aacacuaauuca

SEQ ID NO: 2536 - RNA, 12 nt, Artificial Sequence
  source: /note="Description of Artificial Sequence: Synthetic oligonucleotide"
acacuaauucau

SEQ ID NO: 2537 - RNA, 12 nt, Artificial Sequence
  source: /note="Description of Artificial Sequence: Synthetic oligonucleotide"
cacuaauucaua

SEQ ID NO: 2538 - RNA, 12 nt, Artificial Sequence
  source: /note="Description of Artificial Sequence: Synthetic oligonucleotide"
acuaauucauaa

SEQ ID NO: 2539 - RNA, 12 nt, Artificial Sequence
  source: /note="Description of Artificial Sequence: Synthetic oligonucleotide"
cuaauucauaau

SEQ ID NO: 2540 - RNA, 12 nt, Artificial Sequence
  source: /note="Description of Artificial Sequence: Synthetic oligonucleotide"
uaauucauaauc

SEQ ID NO: 2541 - RNA, 12 nt, Artificial Sequence
  source: /note="Description of Artificial Sequence: Synthetic oligonucleotide"
aauucauaauca

SEQ ID NO: 2542 - RNA, 12 nt, Artificial Sequence
  source: /note="Description of Artificial Sequence: Synthetic oligonucleotide"
auucauaaucac

SEQ ID NO: 2543 - RNA, 12 nt, Artificial Sequence
  source: /note="Description of Artificial Sequence: Synthetic oligonucleotide"
uucauaaucacu

SEQ ID NO: 2544 - RNA, 12 nt, Artificial Sequence
  source: /note="Description of Artificial Sequence: Synthetic oligonucleotide"
ucauaaucacuc

SEQ ID NO: 2545 - RNA, 12 nt, Artificial Sequence
  source: /note="Description of Artificial Sequence: Synthetic oligonucleotide"
cauaaucacucu

SEQ ID NO: 2546 - RNA, 12 nt, Artificial Sequence
  source: /note="Description of Artificial Sequence: Synthetic oligonucleotide"
auaaucacucua

SEQ ID NO: 2547 - RNA, 12 nt, Artificial Sequence
  source: /note="Description of Artificial Sequence: Synthetic oligonucleotide"
uaaucacucuaa

SEQ ID NO: 2548 - RNA, 12 nt, Artificial Sequence
  source: /note="Description of Artificial Sequence: Synthetic oligonucleotide"
aauuguaaucug

SEQ ID NO: 2549 - RNA, 12 nt, Artificial Sequence
  source: /note="Description of Artificial Sequence: Synthetic oligonucleotide"
auuguaaucuga

SEQ ID NO: 2550 - RNA, 12 nt, Artificial Sequence
  source: /note="Description of Artificial Sequence: Synthetic oligonucleotide"
uuguaaucugaa

SEQ ID NO: 2551 - RNA, 12 nt, Artificial Sequence
  source: /note="Description of Artificial Sequence: Synthetic oligonucleotide"
uguaaucugaau

SEQ ID NO: 2552 - RNA, 12 nt, Artificial Sequence
  source: /note="Description of Artificial Sequence: Synthetic oligonucleotide"
guaaucugaaua

SEQ ID NO: 2553 - RNA, 12 nt, Artificial Sequence
  source: /note="Description of Artificial Sequence: Synthetic oligonucleotide"
uaaucugaauaa

SEQ ID NO: 2554 - RNA, 12 nt, Artificial Sequence
  source: /note="Description of Artificial Sequence: Synthetic oligonucleotide"
aaucugaauaaa

SEQ ID NO: 2555 - RNA, 12 nt, Artificial Sequence
  source: /note="Description of Artificial Sequence: Synthetic oligonucleotide"
aucugaauaaag

SEQ ID NO: 2556 - RNA, 12 nt, Artificial Sequence
  source: /note="Description of Artificial Sequence: Synthetic oligonucleotide"
ucugaauaaagu

SEQ ID NO: 2557 - RNA, 12 nt, Artificial Sequence
  source: /note="Description of Artificial Sequence: Synthetic oligonucleotide"
cugaauaaagug

SEQ ID NO: 2558 - RNA, 12 nt, Artificial Sequence
  source: /note="Description of Artificial Sequence: Synthetic oligonucleotide"
uuguauaaaaua

SEQ ID NO: 2559 - RNA, 12 nt, Artificial Sequence
  source: /note="Description of Artificial Sequence: Synthetic oligonucleotide"
uguauaaaauag

SEQ ID NO: 2560 - RNA, 12 nt, Artificial Sequence
  source: /note="Description of Artificial Sequence: Synthetic oligonucleotide"
guauaaaauaga

SEQ ID NO: 2561 - RNA, 12 nt, Artificial Sequence
  source: /note="Description of Artificial Sequence: Synthetic oligonucleotide"
uauaaaauagac

SEQ ID NO: 2562 - RNA, 12 nt, Artificial Sequence
  source: /note="Description of Artificial Sequence: Synthetic oligonucleotide"
auaaaauagaca

SEQ ID NO: 2563 - RNA, 12 nt, Artificial Sequence
  source: /note="Description of Artificial Sequence: Synthetic oligonucleotide"
uaaaauagacaa

SEQ ID NO: 2564 - RNA, 12 nt, Artificial Sequence
  source: /note="Description of Artificial Sequence: Synthetic oligonucleotide"
aaaauagacaaa

SEQ ID NO: 2565 - RNA, 12 nt, Artificial Sequence
  source: /note="Description of Artificial Sequence: Synthetic oligonucleotide"
aaauagacaaau

SEQ ID NO: 2566 - RNA, 12 nt, Artificial Sequence
  source: /note="Description of Artificial Sequence: Synthetic oligonucleotide"
aauagacaaaua

SEQ ID NO: 2567 - RNA, 12 nt, Artificial Sequence
  source: /note="Description of Artificial Sequence: Synthetic oligonucleotide"
auagacaaauag

SEQ ID NO: 2568 - RNA, 12 nt, Artificial Sequence
  source: /note="Description of Artificial Sequence: Synthetic oligonucleotide"
uagacaaauaga

SEQ ID NO: 2569 - RNA, 12 nt, Artificial Sequence
  source: /note="Description of Artificial Sequence: Synthetic oligonucleotide"
agacaaauagaa

SEQ ID NO: 2570 - RNA, 12 nt, Artificial Sequence
  source: /note="Description of Artificial Sequence: Synthetic oligonucleotide"
gacaaauagaaa

SEQ ID NO: 2571 - RNA, 12 nt, Artificial Sequence
  source: /note="Description of Artificial Sequence: Synthetic oligonucleotide"
acaaauagaaaa

SEQ ID NO: 2572 - RNA, 12 nt, Artificial Sequence
  source: /note="Description of Artificial Sequence: Synthetic oligonucleotide"
caaauagaaaau

SEQ ID NO: 2573 - RNA, 12 nt, Artificial Sequence
  source: /note="Description of Artificial Sequence: Synthetic oligonucleotide"
aaauagaaaaug

SEQ ID NO: 2574 - RNA, 12 nt, Artificial Sequence
  source: /note="Description of Artificial Sequence: Synthetic oligonucleotide"
aauagaaaaugg

SEQ ID NO: 2575 - RNA, 12 nt, Artificial Sequence
  source: /note="Description of Artificial Sequence: Synthetic oligonucleotide"
auagaaaauggu

SEQ ID NO: 2576 - RNA, 12 nt, Artificial Sequence
  source: /note="Description of Artificial Sequence: Synthetic oligonucleotide"
uagaaaaugguc

SEQ ID NO: 2577 - RNA, 12 nt, Artificial Sequence
  source: /note="Description of Artificial Sequence: Synthetic oligonucleotide"
agaaaauggucc

SEQ ID NO: 2578 - RNA, 12 nt, Artificial Sequence
  source: /note="Description of Artificial Sequence: Synthetic oligonucleotide"
gaaaauggucca

SEQ ID NO: 2579 - RNA, 12 nt, Artificial Sequence
  source: /note="Description of Artificial Sequence: Synthetic oligonucleotide"
aaaaugguccaa

SEQ ID NO: 2580 - RNA, 12 nt, Artificial Sequence
  source: /note="Description of Artificial Sequence: Synthetic oligonucleotide"
aaaugguccaau

SEQ ID NO: 2581 - RNA, 12 nt, Artificial Sequence
  source: /note="Description of Artificial Sequence: Synthetic oligonucleotide"
aaugguccaauu

SEQ ID NO: 2582 - RNA, 12 nt, Artificial Sequence
  source: /note="Description of Artificial Sequence: Synthetic oligonucleotide"
augguccaauua

SEQ ID NO: 2583 - RNA, 12 nt, Artificial Sequence
  source: /note="Description of Artificial Sequence: Synthetic oligonucleotide"
ugguccaauuag

SEQ ID NO: 2584 - RNA, 12 nt, Artificial Sequence
  source: /note="Description of Artificial Sequence: Synthetic oligonucleotide"
augcuuaaaaua

SEQ ID NO: 2585 - RNA, 12 nt, Artificial Sequence
  source: /note="Description of Artificial Sequence: Synthetic oligonucleotide"
ugcuuaaaauaa

SEQ ID NO: 2586 - RNA, 12 nt, Artificial Sequence
  source: /note="Description of Artificial Sequence: Synthetic oligonucleotide"
gcuuaaaauaag

SEQ ID NO: 2587 - RNA, 12 nt, Artificial Sequence
  source: /note="Description of Artificial Sequence: Synthetic oligonucleotide"
cuuaaaauaagc

SEQ ID NO: 2588 - RNA, 12 nt, Artificial Sequence
  source: /note="Description of Artificial Sequence: Synthetic oligonucleotide"
uuaaaauaagca

SEQ ID NO: 2589 - RNA, 12 nt, Artificial Sequence
  source: /note="Description of Artificial Sequence: Synthetic oligonucleotide"
uaaaauaagcag

SEQ ID NO: 2590 - RNA, 12 nt, Artificial Sequence
  source: /note="Description of Artificial Sequence: Synthetic oligonucleotide"
aaaauaagcagg

SEQ ID NO: 2591 - RNA, 12 nt, Artificial Sequence
  source: /note="Description of Artificial Sequence: Synthetic oligonucleotide"
aaauaagcaggu

SEQ ID NO: 2592 - RNA, 12 nt, Artificial Sequence
  source: /note="Description of Artificial Sequence: Synthetic oligonucleotide"
aauaagcaggug

SEQ ID NO: 2593 - RNA, 12 nt, Artificial Sequence
  source: /note="Description of Artificial Sequence: Synthetic oligonucleotide"
auaagcaggugg

SEQ ID NO: 2594 - RNA, 12 nt, Artificial Sequence
  source: /note="Description of Artificial Sequence: Synthetic oligonucleotide"
uaagcaggugga

SEQ ID NO: 2595 - RNA, 12 nt, Artificial Sequence
  source: /note="Description of Artificial Sequence: Synthetic oligonucleotide"
aagcagguggau

SEQ ID NO: 2596 - RNA, 12 nt, Artificial Sequence
  source: /note="Description of Artificial Sequence: Synthetic oligonucleotide"
agcagguggauc

SEQ ID NO: 2597 - RNA, 12 nt, Artificial Sequence
  source: /note="Description of Artificial Sequence: Synthetic oligonucleotide"
gcagguggaucu

SEQ ID NO: 2598 - RNA, 12 nt, Artificial Sequence
  source: /note="Description of Artificial Sequence: Synthetic oligonucleotide"
cagguggaucua

SEQ ID NO: 2599 - RNA, 12 nt, Artificial Sequence
  source: /note="Description of Artificial Sequence: Synthetic oligonucleotide"
agguggaucuau

SEQ ID NO: 2600 - RNA, 12 nt, Artificial Sequence
  source: /note="Description of Artificial Sequence: Synthetic oligonucleotide"
gguggaucuauu

SEQ ID NO: 2601 - RNA, 12 nt, Artificial Sequence
  source: /note="Description of Artificial Sequence: Synthetic oligonucleotide"
guggaucuauuu

SEQ ID NO: 2602 - RNA, 12 nt, Artificial Sequence
  source: /note="Description of Artificial Sequence: Synthetic oligonucleotide"
uggaucuauuuc

SEQ ID NO: 2603 - RNA, 12 nt, Artificial Sequence
  source: /note="Description of Artificial Sequence: Synthetic oligonucleotide"
ggaucuauuuca

SEQ ID NO: 2604 - RNA, 12 nt, Artificial Sequence
  source: /note="Description of Artificial Sequence: Synthetic oligonucleotide"
gaucuauuucau

SEQ ID NO: 2605 - RNA, 12 nt, Artificial Sequence
  source: /note="Description of Artificial Sequence: Synthetic oligonucleotide"
aucuauuucaug

SEQ ID NO: 2606 - RNA, 12 nt, Artificial Sequence
  source: /note="Description of Artificial Sequence: Synthetic oligonucleotide"
auuugggauaug

SEQ ID NO: 2607 - RNA, 12 nt, Artificial Sequence
  source: /note="Description of Artificial Sequence: Synthetic oligonucleotide"
uuugggauaugu

SEQ ID NO: 2608 - RNA, 12 nt, Artificial Sequence
  source: /note="Description of Artificial Sequence: Synthetic oligonucleotide"
uugggauaugua

SEQ ID NO: 2609 - RNA, 12 nt, Artificial Sequence
  source: /note="Description of Artificial Sequence: Synthetic oligonucleotide"
ugggauauguau

SEQ ID NO: 2610 - RNA, 12 nt, Artificial Sequence
  source: /note="Description of Artificial Sequence: Synthetic oligonucleotide"
gggauauguaug

SEQ ID NO: 2611 - RNA, 12 nt, Artificial Sequence
  source: /note="Description of Artificial Sequence: Synthetic oligonucleotide"
ggauauguaugg

SEQ ID NO: 2612 - RNA, 12 nt, Artificial Sequence
  source: /note="Description of Artificial Sequence: Synthetic oligonucleotide"
gauauguauggg

SEQ ID NO: 2613 - RNA, 12 nt, Artificial Sequence
  source: /note="Description of Artificial Sequence: Synthetic oligonucleotide"
auauguaugggu

SEQ ID NO: 2614 - RNA, 12 nt, Artificial Sequence
  source: /note="Description of Artificial Sequence: Synthetic oligonucleotide"
uauguaugggua

SEQ ID NO: 2615 - RNA, 12 nt, Artificial Sequence
  source: /note="Description of Artificial Sequence: Synthetic oligonucleotide"
auguauggguag

SEQ ID NO: 2616 - RNA, 12 nt, Artificial Sequence
  source: /note="Description of Artificial Sequence: Synthetic oligonucleotide"
uguauggguagg

SEQ ID NO: 2617 - RNA, 12 nt, Artificial Sequence
  source: /note="Description of Artificial Sequence: Synthetic oligonucleotide"
guauggguaggg

SEQ ID NO: 2618 - RNA, 12 nt, Artificial Sequence
  source: /note="Description of Artificial Sequence: Synthetic oligonucleotide"
uauggguagggu

SEQ ID NO: 2619 - RNA, 12 nt, Artificial Sequence
  source: /note="Description of Artificial Sequence: Synthetic oligonucleotide"
gguaggguaaau

SEQ ID NO: 2620 - RNA, 12 nt, Artificial Sequence
  source: /note="Description of Artificial Sequence: Synthetic oligonucleotide"
guaggguaaauc

SEQ ID NO: 2621 - RNA, 12 nt, Artificial Sequence
  source: /note="Description of Artificial Sequence: Synthetic oligonucleotide"
uaggguaaauca

SEQ ID NO: 2622 - RNA, 12 nt, Artificial Sequence
  source: /note="Description of Artificial Sequence: Synthetic oligonucleotide"
aggguaaaucag

SEQ ID NO: 2623 - RNA, 12 nt, Artificial Sequence
  source: /note="Description of Artificial Sequence: Synthetic oligonucleotide"
ggguaaaucagu

SEQ ID NO: 2624 - RNA, 12 nt, Artificial Sequence
  source: /note="Description of Artificial Sequence: Synthetic oligonucleotide"
gguaaaucagua

SEQ ID NO: 2625 - RNA, 12 nt, Artificial Sequence
  source: /note="Description of Artificial Sequence: Synthetic oligonucleotide"
guaaaucaguaa

SEQ ID NO: 2626 - RNA, 12 nt, Artificial Sequence
  source: /note="Description of Artificial Sequence: Synthetic oligonucleotide"
uaaaucaguaag

SEQ ID NO: 2627 - RNA, 12 nt, Artificial Sequence
  source: /note="Description of Artificial Sequence: Synthetic oligonucleotide"
aaaucaguaaga

SEQ ID NO: 2628 - RNA, 12 nt, Artificial Sequence
  source: /note="Description of Artificial Sequence: Synthetic oligonucleotide"
aaucaguaagag

SEQ ID NO: 2629 - RNA, 12 nt, Artificial Sequence
  source: /note="Description of Artificial Sequence: Synthetic oligonucleotide"
aucaguaagagg

SEQ ID NO: 2630 - RNA, 12 nt, Artificial Sequence
  source: /note="Description of Artificial Sequence: Synthetic oligonucleotide"
ucaguaagaggu

SEQ ID NO: 2631 - RNA, 12 nt, Artificial Sequence
  source: /note="Description of Artificial Sequence: Synthetic oligonucleotide"
caguaagaggug

SEQ ID NO: 2632 - RNA, 12 nt, Artificial Sequence
  source: /note="Description of Artificial Sequence: Synthetic oligonucleotide"
aguaagaggugu

SEQ ID NO: 2633 - RNA, 12 nt, Artificial Sequence
  source: /note="Description of Artificial Sequence: Synthetic oligonucleotide"
guaagagguguu

SEQ ID NO: 2634 - RNA, 12 nt, Artificial Sequence
  source: /note="Description of Artificial Sequence: Synthetic oligonucleotide"
uaagagguguua

SEQ ID NO: 2635 - RNA, 12 nt, Artificial Sequence
  source: /note="Description of Artificial Sequence: Synthetic oligonucleotide"
aagagguguuau

SEQ ID NO: 2636 - RNA, 12 nt, Artificial Sequence
  source: /note="Description of Artificial Sequence: Synthetic oligonucleotide"
agagguguuauu

SEQ ID NO: 2637 - RNA, 12 nt, Artificial Sequence
  source: /note="Description of Artificial Sequence: Synthetic oligonucleotide"
gagguguuauuu

SEQ ID NO: 2638 - RNA, 12 nt, Artificial Sequence
  source: /note="Description of Artificial Sequence: Synthetic oligonucleotide"
agguguuauuug

SEQ ID NO: 2639 - RNA, 12 nt, Artificial Sequence
  source: /note="Description of Artificial Sequence: Synthetic oligonucleotide"
gguguuauuugg

SEQ ID NO: 2640 - RNA, 12 nt, Artificial Sequence
  source: /note="Description of Artificial Sequence: Synthetic oligonucleotide"
guguuauuugga

SEQ ID NO: 2641 - RNA, 12 nt, Artificial Sequence
  source: /note="Description of Artificial Sequence: Synthetic oligonucleotide"
uguuauuuggaa

SEQ ID NO: 2642 - RNA, 12 nt, Artificial Sequence
  source: /note="Description of Artificial Sequence: Synthetic oligonucleotide"
guuauuuggaac

SEQ ID NO: 2643 - RNA, 12 nt, Artificial Sequence
  source: /note="Description of Artificial Sequence: Synthetic oligonucleotide"
uuauuuggaacc

SEQ ID NO: 2644 - RNA, 12 nt, Artificial Sequence
  source: /note="Description of Artificial Sequence: Synthetic oligonucleotide"
ggaaccuuguuu

SEQ ID NO: 2645 - RNA, 12 nt, Artificial Sequence
  source: /note="Description of Artificial Sequence: Synthetic oligonucleotide"
gaaccuuguuuu

SEQ ID NO: 2646 - RNA, 12 nt, Artificial Sequence
  source: /note="Description of Artificial Sequence: Synthetic oligonucleotide"
aaccuuguuuug

SEQ ID NO: 2647 - RNA, 12 nt, Artificial Sequence
  source: /note="Description of Artificial Sequence: Synthetic oligonucleotide"
accuuguuuugg

SEQ ID NO: 2648 - RNA, 12 nt, Artificial Sequence
  source: /note="Description of Artificial Sequence: Synthetic oligonucleotide"
ccuuguuuugga

SEQ ID NO: 2649 - RNA, 12 nt, Artificial Sequence
  source: /note="Description of Artificial Sequence: Synthetic oligonucleotide"
cuuguuuuggac

SEQ ID NO: 2650 - RNA, 12 nt, Artificial Sequence
  source: /note="Description of Artificial Sequence: Synthetic oligonucleotide"
uuguuuuggaca

SEQ ID NO: 2651 - RNA, 12 nt, Artificial Sequence
  source: /note="Description of Artificial Sequence: Synthetic oligonucleotide"
uguuuuggacag

SEQ ID NO: 2652 - RNA, 12 nt, Artificial Sequence
  source: /note="Description of Artificial Sequence: Synthetic oligonucleotide"
guuuuggacagu

SEQ ID NO: 2653 - RNA, 12 nt, Artificial Sequence
  source: /note="Description of Artificial Sequence: Synthetic oligonucleotide"
uuuuggacaguu

SEQ ID NO: 2654 - RNA, 12 nt, Artificial Sequence
  source: /note="Description of Artificial Sequence: Synthetic oligonucleotide"
uuuggacaguuu

SEQ ID NO: 2655 - RNA, 12 nt, Artificial Sequence
  source: /note="Description of Artificial Sequence: Synthetic oligonucleotide"
uuggacaguuua

SEQ ID NO: 2656 - RNA, 12 nt, Artificial Sequence
  source: /note="Description of Artificial Sequence: Synthetic oligonucleotide"
uggacaguuuac

SEQ ID NO: 2657 - RNA, 12 nt, Artificial Sequence
  source: /note="Description of Artificial Sequence: Synthetic oligonucleotide"
ggacaguuuacc

SEQ ID NO: 2658 - RNA, 12 nt, Artificial Sequence
  source: /note="Description of Artificial Sequence: Synthetic oligonucleotide"
gacaguuuacca

SEQ ID NO: 2659 - RNA, 12 nt, Artificial Sequence
  source: /note="Description of Artificial Sequence: Synthetic oligonucleotide"
acaguuuaccag

SEQ ID NO: 2660 - RNA, 12 nt, Artificial Sequence
  source: /note="Description of Artificial Sequence: Synthetic oligonucleotide"
caguuuaccagu

SEQ ID NO: 2661 - RNA, 12 nt, Artificial Sequence
  source: /note="Description of Artificial Sequence: Synthetic oligonucleotide"
aguuuaccaguu

SEQ ID NO: 2662 - RNA, 12 nt, Artificial Sequence
  source: /note="Description of Artificial Sequence: Synthetic oligonucleotide"
accaguugccuu

SEQ ID NO: 2663 - RNA, 12 nt, Artificial Sequence
  source: /note="Description of Artificial Sequence: Synthetic oligonucleotide"
ccaguugccuuu

SEQ ID NO: 2664 - RNA, 12 nt, Artificial Sequence
  source: /note="Description of Artificial Sequence: Synthetic oligonucleotide"
caguugccuuuu

SEQ ID NO: 2665 - RNA, 12 nt, Artificial Sequence
  source: /note="Description of Artificial Sequence: Synthetic oligonucleotide"
aguugccuuuua

SEQ ID NO: 2666 - RNA, 12 nt, Artificial Sequence
  source: /note="Description of Artificial Sequence: Synthetic oligonucleotide"
guugccuuuuau

SEQ ID NO: 2667 - RNA, 12 nt, Artificial Sequence
  source: /note="Description of Artificial Sequence: Synthetic oligonucleotide"
uugccuuuuauc

SEQ ID NO: 2668 - RNA, 12 nt, Artificial Sequence
  source: /note="Description of Artificial Sequence: Synthetic oligonucleotide"
ugccuuuuaucc

SEQ ID NO: 2669 - RNA, 12 nt, Artificial Sequence
  source: /note="Description of Artificial Sequence: Synthetic oligonucleotide"
gccuuuuauccc

SEQ ID NO: 2670 - RNA, 12 nt, Artificial Sequence
  source: /note="Description of Artificial Sequence: Synthetic oligonucleotide"
ccuuuuauccca

SEQ ID NO: 2671 - RNA, 12 nt, Artificial Sequence
  source: /note="Description of Artificial Sequence: Synthetic oligonucleotide"
cuuuuaucccaa

SEQ ID NO: 2672 - RNA, 12 nt, Artificial Sequence
  source: /note="Description of Artificial Sequence: Synthetic oligonucleotide"
uuuuaucccaaa

SEQ ID NO: 2673 - RNA, 12 nt, Artificial Sequence
  source: /note="Description of Artificial Sequence: Synthetic oligonucleotide"
uuuaucccaaag

SEQ ID NO: 2674 - RNA, 12 nt, Artificial Sequence
  source: /note="Description of Artificial Sequence: Synthetic oligonucleotide"
uuaucccaaagu

SEQ ID NO: 2675 - RNA, 12 nt, Artificial Sequence
  source: /note="Description of Artificial Sequence: Synthetic oligonucleotide"
uaucccaaaguu

SEQ ID NO: 2676 - RNA, 12 nt, Artificial Sequence
  source: /note="Description of Artificial Sequence: Synthetic oligonucleotide"
aucccaaaguug

SEQ ID NO: 2677 - RNA, 12 nt, Artificial Sequence
  source: /note="Description of Artificial Sequence: Synthetic oligonucleotide"
ucccaaaguugu

SEQ ID NO: 2678 - RNA, 12 nt, Artificial Sequence
  source: /note="Description of Artificial Sequence: Synthetic oligonucleotide"
cccaaaguuguu

SEQ ID NO: 2679 - RNA, 12 nt, Artificial Sequence
  source: /note="Description of Artificial Sequence: Synthetic oligonucleotide"
ccaaaguuguug

SEQ ID NO: 2680 - RNA, 12 nt, Artificial Sequence
  source: /note="Description of Artificial Sequence: Synthetic oligonucleotide"
caaaguuguugu

SEQ ID NO: 2681 - RNA, 12 nt, Artificial Sequence
  source: /note="Description of Artificial Sequence: Synthetic oligonucleotide"
aaaguuguugua

SEQ ID NO: 2682 - RNA, 12 nt, Artificial Sequence
  source: /note="Description of Artificial Sequence: Synthetic oligonucleotide"
aaguuguuguaa

SEQ ID NO: 2683 - RNA, 12 nt, Artificial Sequence
  source: /note="Description of Artificial Sequence: Synthetic oligonucleotide"
aguuguuguaac

SEQ ID NO: 2684 - RNA, 12 nt, Artificial Sequence
  source: /note="Description of Artificial Sequence: Synthetic oligonucleotide"
guuguuguaacc

SEQ ID NO: 2685 - RNA, 12 nt, Artificial Sequence
  source: /note="Description of Artificial Sequence: Synthetic oligonucleotide"
uuguuguaaccu

SEQ ID NO: 2686 - RNA, 12 nt, Artificial Sequence
  source: /note="Description of Artificial Sequence: Synthetic oligonucleotide"
uguuguaaccug

SEQ ID NO: 2687 - RNA, 12 nt, Artificial Sequence
  source: /note="Description of Artificial Sequence: Synthetic oligonucleotide"
guuguaaccugc

SEQ ID NO: 2688 - RNA, 12 nt, Artificial Sequence
  source: /note="Description of Artificial Sequence: Synthetic oligonucleotide"
uuguaaccugcu

SEQ ID NO: 2689 - RNA, 12 nt, Artificial Sequence
  source: /note="Description of Artificial Sequence: Synthetic oligonucleotide"
uguaaccugcug

SEQ ID NO: 2690 - RNA, 12 nt, Artificial Sequence
  source: /note="Description of Artificial Sequence: Synthetic oligonucleotide"
guaaccugcugu

SEQ ID NO: 2691 - RNA, 12 nt, Artificial Sequence
  source: /note="Description of Artificial Sequence: Synthetic oligonucleotide"
uaaccugcugug

SEQ ID NO: 2692 - RNA, 12 nt, Artificial Sequence
  source: /note="Description of Artificial Sequence: Synthetic oligonucleotide"
aaccugcuguga

SEQ ID NO: 2693 - RNA, 12 nt, Artificial Sequence
  source: /note="Description of Artificial Sequence: Synthetic oligonucleotide"
accugcugugau

SEQ ID NO: 2694 - RNA, 12 nt, Artificial Sequence
  source: /note="Description of Artificial Sequence: Synthetic oligonucleotide"
ccugcugugaua

SEQ ID NO: 2695 - RNA, 12 nt, Artificial Sequence
  source: /note="Description of Artificial Sequence: Synthetic oligonucleotide"
caagagaaaaug

SEQ ID NO: 2696 - RNA, 12 nt, Artificial Sequence
  source: /note="Description of Artificial Sequence: Synthetic oligonucleotide"
aagagaaaaugc

SEQ ID NO: 2697 - RNA, 12 nt, Artificial Sequence
  source: /note="Description of Artificial Sequence: Synthetic oligonucleotide"
agagaaaaugcg

SEQ ID NO: 2698 - RNA, 12 nt, Artificial Sequence
  source: /note="Description of Artificial Sequence: Synthetic oligonucleotide"
gagaaaaugcgg

SEQ ID NO: 2699 - RNA, 12 nt, Artificial Sequence
  source: /note="Description of Artificial Sequence: Synthetic oligonucleotide"
agaaaaugcggu

SEQ ID NO: 2700 - RNA, 12 nt, Artificial Sequence
  source: /note="Description of Artificial Sequence: Synthetic oligonucleotide"
gaaaaugcgguu

SEQ ID NO: 2701 - RNA, 12 nt, Artificial Sequence
  source: /note="Description of Artificial Sequence: Synthetic oligonucleotide"
aaaaugcgguua

SEQ ID NO: 2702 - RNA, 12 nt, Artificial Sequence
  source: /note="Description of Artificial Sequence: Synthetic oligonucleotide"
aaaugcgguuau

SEQ ID NO: 2703 - RNA, 12 nt, Artificial Sequence
  source: /note="Description of Artificial Sequence: Synthetic oligonucleotide"
aaugguucagaa

SEQ ID NO: 2704 - RNA, 12 nt, Artificial Sequence
  source: /note="Description of Artificial Sequence: Synthetic oligonucleotide"
augguucagaau

SEQ ID NO: 2705 - RNA, 12 nt, Artificial Sequence
  source: /note="Description of Artificial Sequence: Synthetic oligonucleotide"
ugguucagaauu

SEQ ID NO: 2706 - RNA, 12 nt, Artificial Sequence
  source: /note="Description of Artificial Sequence: Synthetic oligonucleotide"
gguucagaauua

SEQ ID NO: 2707 - RNA, 12 nt, Artificial Sequence
  source: /note="Description of Artificial Sequence: Synthetic oligonucleotide"
guucagaauuaa

SEQ ID NO: 2708 - RNA, 12 nt, Artificial Sequence
  source: /note="Description of Artificial Sequence: Synthetic oligonucleotide"
uucagaauuaaa

SEQ ID NO: 2709 - RNA, 12 nt, Artificial Sequence
  source: /note="Description of Artificial Sequence: Synthetic oligonucleotide"
ucagaauuaaac

SEQ ID NO: 2710 - RNA, 12 nt, Artificial Sequence
  source: /note="Description of Artificial Sequence: Synthetic oligonucleotide"
cagaauuaaacu

SEQ ID NO: 2711 - RNA, 12 nt, Artificial Sequence
  source: /note="Description of Artificial Sequence: Synthetic oligonucleotide"
agaauuaaacuu

SEQ ID NO: 2712 - RNA, 12 nt, Artificial Sequence
  source: /note="Description of Artificial Sequence: Synthetic oligonucleotide"
gaauuaaacuuu

SEQ ID NO: 2713 - RNA, 12 nt, Artificial Sequence
  source: /note="Description of Artificial Sequence: Synthetic oligonucleotide"
aauuaaacuuuu

SEQ ID NO: 2714 - RNA, 12 nt, Artificial Sequence
  source: /note="Description of Artificial Sequence: Synthetic oligonucleotide"
caggggaacagg

SEQ ID NO: 2715 - RNA, 12 nt, Artificial Sequence
  source: /note="Description of Artificial Sequence: Synthetic oligonucleotide"
ucaggggaacag

SEQ ID NO: 2716 - RNA, 12 nt, Artificial Sequence
  source: /note="Description of Artificial Sequence: Synthetic oligonucleotide"
cucaggggaaca

SEQ ID NO: 2717 - RNA, 12 nt, Artificial Sequence
  source: /note="Description of Artificial Sequence: Synthetic oligonucleotide"
ccucaggggaac

SEQ ID NO: 2718 - RNA, 12 nt, Artificial Sequence
  source: /note="Description of Artificial Sequence: Synthetic oligonucleotide"
cccucaggggaa

SEQ ID NO: 2719 - RNA, 12 nt, Artificial Sequence
  source: /note="Description of Artificial Sequence: Synthetic oligonucleotide"
acccucagggga

SEQ ID NO: 2720 - RNA, 12 nt, Artificial Sequence
  source: /note="Description of Artificial Sequence: Synthetic oligonucleotide"
uacccucagggg

SEQ ID NO: 2721 - RNA, 12 nt, Artificial Sequence
  source: /note="Description of Artificial Sequence: Synthetic oligonucleotide"
auacccucaggg

SEQ ID NO: 2722 - RNA, 12 nt, Artificial Sequence
  source: /note="Description of Artificial Sequence: Synthetic oligonucleotide"
aauacccucagg

SEQ ID NO: 2723 - RNA, 12 nt, Artificial Sequence
  source: /note="Description of Artificial Sequence: Synthetic oligonucleotide"
aaauacccucag

SEQ ID NO: 2724 - RNA, 12 nt, Artificial Sequence
  source: /note="Description of Artificial Sequence: Synthetic oligonucleotide"
caaauacccuca

SEQ ID NO: 2725 - RNA, 12 nt, Artificial Sequence
  source: /note="Description of Artificial Sequence: Synthetic oligonucleotide"
ucaaauacccuc

SEQ ID NO: 2726 - RNA, 12 nt, Artificial Sequence
  source: /note="Description of Artificial Sequence: Synthetic oligonucleotide"
uucaaauacccu

SEQ ID NO: 2727 - RNA, 12 nt, Artificial Sequence
  source: /note="Description of Artificial Sequence: Synthetic oligonucleotide"
cuucaaauaccc

SEQ ID NO: 2728 - RNA, 12 nt, Artificial Sequence
  source: /note="Description of Artificial Sequence: Synthetic oligonucleotide"
acuucaaauacc

SEQ ID NO: 2729 - RNA, 12 nt, Artificial Sequence
  source: /note="Description of Artificial Sequence: Synthetic oligonucleotide"
uacuucaaauac

SEQ ID NO: 2730 - RNA, 12 nt, Artificial Sequence
  source: /note="Description of Artificial Sequence: Synthetic oligonucleotide"
auacuucaaaua

SEQ ID NO: 2731 - RNA, 12 nt, Artificial Sequence
  source: /note="Description of Artificial Sequence: Synthetic oligonucleotide"
uauacuucaaau

SEQ ID NO: 2732 - RNA, 12 nt, Artificial Sequence
  source: /note="Description of Artificial Sequence: Synthetic oligonucleotide"
guauacuucaaa

SEQ ID NO: 2733 - RNA, 12 nt, Artificial Sequence
  source: /note="Description of Artificial Sequence: Synthetic oligonucleotide"
gguauacuucaa

SEQ ID NO: 2734 - RNA, 12 nt, Artificial Sequence
  source: /note="Description of Artificial Sequence: Synthetic oligonucleotide"
ugguauacuuca

SEQ ID NO: 2735 - RNA, 12 nt, Artificial Sequence
  source: /note="Description of Artificial Sequence: Synthetic oligonucleotide"
augguauacuuc

SEQ ID NO: 2736 - RNA, 12 nt, Artificial Sequence
  source: /note="Description of Artificial Sequence: Synthetic oligonucleotide"
uaugguauacuu

SEQ ID NO: 2737 - RNA, 12 nt, Artificial Sequence
  source: /note="Description of Artificial Sequence: Synthetic oligonucleotide"
guaugguauacu

SEQ ID NO: 2738 - RNA, 12 nt, Artificial Sequence
  source: /note="Description of Artificial Sequence: Synthetic oligonucleotide"
uguaugguauac

SEQ ID NO: 2739 - RNA, 12 nt, Artificial Sequence
  source: /note="Description of Artificial Sequence: Synthetic oligonucleotide"
uuguaugguaua

SEQ ID NO: 2740 - RNA, 12 nt, Artificial Sequence
  source: /note="Description of Artificial Sequence: Synthetic oligonucleotide"
guuguaugguau

SEQ ID NO: 2741 - RNA, 12 nt, Artificial Sequence
  source: /note="Description of Artificial Sequence: Synthetic oligonucleotide"
aguuguauggua

SEQ ID NO: 2742 - RNA, 12 nt, Artificial Sequence
  source: /note="Description of Artificial Sequence: Synthetic oligonucleotide"
caguuguauggu

SEQ ID NO: 2743 - RNA, 12 nt, Artificial Sequence
  source: /note="Description of Artificial Sequence: Synthetic oligonucleotide"
acaguuguaugg

SEQ ID NO: 2744 - RNA, 12 nt, Artificial Sequence
  source: /note="Description of Artificial Sequence: Synthetic oligonucleotide"
aacaguuguaug

SEQ ID NO: 2745 - RNA, 12 nt, Artificial Sequence
  source: /note="Description of Artificial Sequence: Synthetic oligonucleotide"
aaacaguuguau

SEQ ID NO: 2746 - RNA, 12 nt, Artificial Sequence
  source: /note="Description of Artificial Sequence: Synthetic oligonucleotide"
aaaacaguugua

SEQ ID NO: 2747 - RNA, 12 nt, Artificial Sequence
  source: /note="Description of Artificial Sequence: Synthetic oligonucleotide"
caaaacaguugu

SEQ ID NO: 2748 - RNA, 12 nt, Artificial Sequence
  source: /note="Description of Artificial Sequence: Synthetic oligonucleotide"
ucaaaacaguug

SEQ ID NO: 2749 - RNA, 12 nt, Artificial Sequence
  source: /note="Description of Artificial Sequence: Synthetic oligonucleotide"
uucaaaacaguu

SEQ ID NO: 2750 - RNA, 12 nt, Artificial Sequence
  source: /note="Description of Artificial Sequence: Synthetic oligonucleotide"
cgcuggauuuuc

SEQ ID NO: 2751 - RNA, 12 nt, Artificial Sequence
  source: /note="Description of Artificial Sequence: Synthetic oligonucleotide"
acgcuggauuuu

SEQ ID NO: 2752 - RNA, 12 nt, Artificial Sequence
  source: /note="Description of Artificial Sequence: Synthetic oligonucleotide"
cacgcuggauuu

SEQ ID NO: 2753 - RNA, 12 nt, Artificial Sequence
  source: /note="Description of Artificial Sequence: Synthetic oligonucleotide"
ccacgcuggauu

SEQ ID NO: 2754 - RNA, 12 nt, Artificial Sequence
  source: /note="Description of Artificial Sequence: Synthetic oligonucleotide"
uccacgcuggau

SEQ ID NO: 2755 - RNA, 12 nt, Artificial Sequence
  source: /note="Description of Artificial Sequence: Synthetic oligonucleotide"
guccacgcugga

SEQ ID NO: 2756 - RNA, 12 nt, Artificial Sequence
  source: /note="Description of Artificial Sequence: Synthetic oligonucleotide"
uguccacgcugg

SEQ ID NO: 2757 - RNA, 12 nt, Artificial Sequence
  source: /note="Description of Artificial Sequence: Synthetic oligonucleotide"
uuguccacgcug

SEQ ID NO: 2758 - RNA, 12 nt, Artificial Sequence
  source: /note="Description of Artificial Sequence: Synthetic oligonucleotide"
auuguccacgcu

SEQ ID NO: 2759 - RNA, 12 nt, Artificial Sequence
  source: /note="Description of Artificial Sequence: Synthetic oligonucleotide"
gccauuguccac

SEQ ID NO: 2760 - RNA, 12 nt, Artificial Sequence
  source: /note="Description of Artificial Sequence: Synthetic oligonucleotide"
agccauugucca

SEQ ID NO: 2761 - RNA, 12 nt, Artificial Sequence
  source: /note="Description of Artificial Sequence: Synthetic oligonucleotide"
uagccauugucc

SEQ ID NO: 2762 - RNA, 12 nt, Artificial Sequence
  source: /note="Description of Artificial Sequence: Synthetic oligonucleotide"
guagccauuguc

SEQ ID NO: 2763 - RNA, 12 nt, Artificial Sequence
  source: /note="Description of Artificial Sequence: Synthetic oligonucleotide"
aguagccauugu

SEQ ID NO: 2764 - RNA, 12 nt, Artificial Sequence
  source: /note="Description of Artificial Sequence: Synthetic oligonucleotide"
gaguagccauug

SEQ ID NO: 2765 - RNA, 12 nt, Artificial Sequence
  source: /note="Description of Artificial Sequence: Synthetic oligonucleotide"
ugaguagccauu

SEQ ID NO: 2766 - RNA, 12 nt, Artificial Sequence
  source: /note="Description of Artificial Sequence: Synthetic oligonucleotide"
uugaguagccau

SEQ ID NO: 2767 - RNA, 12 nt, Artificial Sequence
  source: /note="Description of Artificial Sequence: Synthetic oligonucleotide"
cuugaguagcca

SEQ ID NO: 2768 - RNA, 12 nt, Artificial Sequence
  source: /note="Description of Artificial Sequence: Synthetic oligonucleotide"
gcuugaguagcc

SEQ ID NO: 2769 - RNA, 12 nt, Artificial Sequence
  source: /note="Description of Artificial Sequence: Synthetic oligonucleotide"
agcuugaguagc

SEQ ID NO: 2770 - RNA, 12 nt, Artificial Sequence
  source: /note="Description of Artificial Sequence: Synthetic oligonucleotide"
cagcuugaguag

SEQ ID NO: 2771 - RNA, 12 nt, Artificial Sequence
  source: /note="Description of Artificial Sequence: Synthetic oligonucleotide"
ucagcuugagua

SEQ ID NO: 2772 - RNA, 12 nt, Artificial Sequence
  source: /note="Description of Artificial Sequence: Synthetic oligonucleotide"
aucagcuugagu

SEQ ID NO: 2773 - RNA, 12 nt, Artificial Sequence
  source: /note="Description of Artificial Sequence: Synthetic oligonucleotide"
aaucagcuugag

SEQ ID NO: 2774 - RNA, 12 nt, Artificial Sequence
  source: /note="Description of Artificial Sequence: Synthetic oligonucleotide"
aaaucagcuuga

SEQ ID NO: 2775 - RNA, 12 nt, Artificial Sequence
  source: /note="Description of Artificial Sequence: Synthetic oligonucleotide"
uguccaacucca

SEQ ID NO: 2776 - RNA, 12 nt, Artificial Sequence
  source: /note="Description of Artificial Sequence: Synthetic oligonucleotide"
auguccaacucc

SEQ ID NO: 2777 - RNA, 12 nt, Artificial Sequence
  source: /note="Description of Artificial Sequence: Synthetic oligonucleotide"
gccauguccaac

SEQ ID NO: 2778 - RNA, 12 nt, Artificial Sequence
  source: /note="Description of Artificial Sequence: Synthetic oligonucleotide"
ggccauguccaa

SEQ ID NO: 2779 - RNA, 12 nt, Artificial Sequence
  source: /note="Description of Artificial Sequence: Synthetic oligonucleotide"
uggccaugucca

SEQ ID NO: 2780 - RNA, 12 nt, Artificial Sequence
  source: /note="Description of Artificial Sequence: Synthetic oligonucleotide"
auggccaugucc

SEQ ID NO: 2781 - RNA, 12 nt, Artificial Sequence
  source: /note="Description of Artificial Sequence: Synthetic oligonucleotide"
ucugguuccaug

SEQ ID NO: 2782 - RNA, 12 nt, Artificial Sequence
  source: /note="Description of Artificial Sequence: Synthetic oligonucleotide"
gucugguuccau

SEQ ID NO: 2783 - RNA, 12 nt, Artificial Sequence
  source: /note="Description of Artificial Sequence: Synthetic oligonucleotide"
ugucugguucca

SEQ ID NO: 2784 - RNA, 12 nt, Artificial Sequence
  source: /note="Description of Artificial Sequence: Synthetic oligonucleotide"
cugucugguucc

SEQ ID NO: 2785 - RNA, 12 nt, Artificial Sequence
  source: /note="Description of Artificial Sequence: Synthetic oligonucleotide"
ucugucugguuc

SEQ ID NO: 2786 - RNA, 12 nt, Artificial Sequence
  source: /note="Description of Artificial Sequence: Synthetic oligonucleotide"
uucugucugguu

SEQ ID NO: 2787 - RNA, 12 nt, Artificial Sequence
  source: /note="Description of Artificial Sequence: Synthetic oligonucleotide"
cgcuuuucuguc

SEQ ID NO: 2788 - RNA, 12 nt, Artificial Sequence
  source: /note="Description of Artificial Sequence: Synthetic oligonucleotide"
ccgcuuuucugu

SEQ ID NO: 2789 - RNA, 12 nt, Artificial Sequence
  source: /note="Description of Artificial Sequence: Synthetic oligonucleotide"
gccgcuuuucug

SEQ ID NO: 2790 - RNA, 12 nt, Artificial Sequence
  source: /note="Description of Artificial Sequence: Synthetic oligonucleotide"
agccgcuuuucu

SEQ ID NO: 2791 - RNA, 12 nt, Artificial Sequence
  source: /note="Description of Artificial Sequence: Synthetic oligonucleotide"
cagccgcuuuuc

SEQ ID NO: 2792 - RNA, 12 nt, Artificial Sequence
  source: /note="Description of Artificial Sequence: Synthetic oligonucleotide"
acagccgcuuuu

SEQ ID NO: 2793 - RNA, 12 nt, Artificial Sequence
  source: /note="Description of Artificial Sequence: Synthetic oligonucleotide"
aacagccgcuuu

SEQ ID NO: 2794 - RNA, 12 nt, Artificial Sequence
  source: /note="Description of Artificial Sequence: Synthetic oligonucleotide"
uaacagccgcuu

SEQ ID NO: 2795 - RNA, 12 nt, Artificial Sequence
  source: /note="Description of Artificial Sequence: Synthetic oligonucleotide"
cagugacuaaca

SEQ ID NO: 2796 - RNA, 12 nt, Artificial Sequence
  source: /note="Description of Artificial Sequence: Synthetic oligonucleotide"
uugcugccagug

SEQ ID NO: 2797 - RNA, 12 nt, Artificial Sequence
  source: /note="Description of Artificial Sequence: Synthetic oligonucleotide"
guugcugccagu

SEQ ID NO: 2798 - RNA, 12 nt, Artificial Sequence
  source: /note="Description of Artificial Sequence: Synthetic oligonucleotide"
uguugcugccag

SEQ ID NO: 2799 - RNA, 12 nt, Artificial Sequence
  source: /note="Description of Artificial Sequence: Synthetic oligonucleotide"
cuguugcugcca

SEQ ID NO: 2800 - RNA, 12 nt, Artificial Sequence
  source: /note="Description of Artificial Sequence: Synthetic oligonucleotide"
acuguugcugcc

SEQ ID NO: 2801 - RNA, 12 nt, Artificial Sequence
  source: /note="Description of Artificial Sequence: Synthetic oligonucleotide"
gacuguugcugc

SEQ ID NO: 2802 - RNA, 12 nt, Artificial Sequence
  source: /note="Description of Artificial Sequence: Synthetic oligonucleotide"
agacuguugcug

SEQ ID NO: 2803 - RNA, 12 nt, Artificial Sequence
  source: /note="Description of Artificial Sequence: Synthetic oligonucleotide"
aagacuguugcu

SEQ ID NO: 2804 - RNA, 12 nt, Artificial Sequence
  source: /note="Description of Artificial Sequence: Synthetic oligonucleotide"
aguccagguaag

SEQ ID NO: 2805 - RNA, 12 nt, Artificial Sequence
  source: /note="Description of Artificial Sequence: Synthetic oligonucleotide"
gaguccagguaa

SEQ ID NO: 2806 - RNA, 12 nt, Artificial Sequence
  source: /note="Description of Artificial Sequence: Synthetic oligonucleotide"
agaguccaggua

SEQ ID NO: 2807 - RNA, 12 nt, Artificial Sequence
  source: /note="Description of Artificial Sequence: Synthetic oligonucleotide"
cagaguccaggu

SEQ ID NO: 2808 - RNA, 12 nt, Artificial Sequence
  source: /note="Description of Artificial Sequence: Synthetic oligonucleotide"
ccagaguccagg

SEQ ID NO: 2809 - RNA, 12 nt, Artificial Sequence
  source: /note="Description of Artificial Sequence: Synthetic oligonucleotide"
uccagaguccag

SEQ ID NO: 2810 - RNA, 12 nt, Artificial Sequence
  source: /note="Description of Artificial Sequence: Synthetic oligonucleotide"
uuccagagucca

SEQ ID NO: 2811 - RNA, 12 nt, Artificial Sequence
  source: /note="Description of Artificial Sequence: Synthetic oligonucleotide"
auuccagagucc

SEQ ID NO: 2812 - RNA, 12 nt, Artificial Sequence
  source: /note="Description of Artificial Sequence: Synthetic oligonucleotide"
gaauggauucca

SEQ ID NO: 2813 - RNA, 12 nt, Artificial Sequence
  source: /note="Description of Artificial Sequence: Synthetic oligonucleotide"
agaauggauucc

SEQ ID NO: 2814 - RNA, 12 nt, Artificial Sequence
  source: /note="Description of Artificial Sequence: Synthetic oligonucleotide"
cagaauggauuc

SEQ ID NO: 2815 - RNA, 12 nt, Artificial Sequence
  source: /note="Description of Artificial Sequence: Synthetic oligonucleotide"
ccagaauggauu

SEQ ID NO: 2816 - RNA, 12 nt, Artificial Sequence
  source: /note="Description of Artificial Sequence: Synthetic oligonucleotide"
accagaauggau

SEQ ID NO: 2817 - RNA, 12 nt, Artificial Sequence
  source: /note="Description of Artificial Sequence: Synthetic oligonucleotide"
caccagaaugga

SEQ ID NO: 2818 - RNA, 12 nt, Artificial Sequence
  source: /note="Description of Artificial Sequence: Synthetic oligonucleotide"
gcaccagaaugg

SEQ ID NO: 2819 - RNA, 12 nt, Artificial Sequence
  source: /note="Description of Artificial Sequence: Synthetic oligonucleotide"
uaccacucagag

SEQ ID NO: 2820 - RNA, 12 nt, Artificial Sequence
  source: /note="Description of Artificial Sequence: Synthetic oligonucleotide"
uuaccacucaga

SEQ ID NO: 2821 - RNA, 12 nt, Artificial Sequence
  source: /note="Description of Artificial Sequence: Synthetic oligonucleotide"
uuuaccacucag

SEQ ID NO: 2822 - RNA, 12 nt, Artificial Sequence
  source: /note="Description of Artificial Sequence: Synthetic oligonucleotide"
uccucaggauug

SEQ ID NO: 2823 - RNA, 12 nt, Artificial Sequence
  source: /note="Description of Artificial Sequence: Synthetic oligonucleotide"
uuccucaggauu

SEQ ID NO: 2824 - RNA, 12 nt, Artificial Sequence
  source: /note="Description of Artificial Sequence: Synthetic oligonucleotide"
uccucuuccuca

SEQ ID NO: 2825 - RNA, 12 nt, Artificial Sequence
  source: /note="Description of Artificial Sequence: Synthetic oligonucleotide"
auccucuuccuc

SEQ ID NO: 2826 - RNA, 12 nt, Artificial Sequence
  source: /note="Description of Artificial Sequence: Synthetic oligonucleotide"
acuugggaggua

SEQ ID NO: 2827 - RNA, 12 nt, Artificial Sequence
  source: /note="Description of Artificial Sequence: Synthetic oligonucleotide"
gacuugggaggu

SEQ ID NO: 2828 - RNA, 12 nt, Artificial Sequence
  source: /note="Description of Artificial Sequence: Synthetic oligonucleotide"
ggacuugggagg

SEQ ID NO: 2829 - RNA, 12 nt, Artificial Sequence
  source: /note="Description of Artificial Sequence: Synthetic oligonucleotide"
aggacuugggag

SEQ ID NO: 2830 - RNA, 12 nt, Artificial Sequence
  source: /note="Description of Artificial Sequence: Synthetic oligonucleotide"
caggacuuggga

SEQ ID NO: 2831 - RNA, 12 nt, Artificial Sequence
  source: /note="Description of Artificial Sequence: Synthetic oligonucleotide"
acaggacuuggg

SEQ ID NO: 2832 - RNA, 12 nt, Artificial Sequence
  source: /note="Description of Artificial Sequence: Synthetic oligonucleotide"
uacaggacuugg

SEQ ID NO: 2833 - RNA, 12 nt, Artificial Sequence
  source: /note="Description of Artificial Sequence: Synthetic oligonucleotide"
uucccacucaua

SEQ ID NO: 2834 - RNA, 12 nt, Artificial Sequence
  source: /note="Description of Artificial Sequence: Synthetic oligonucleotide"
uguucccacuca

SEQ ID NO: 2835 - RNA, 12 nt, Artificial Sequence
  source: /note="Description of Artificial Sequence: Synthetic oligonucleotide"
cuguucccacuc

SEQ ID NO: 2836 - RNA, 12 nt, Artificial Sequence
  source: /note="Description of Artificial Sequence: Synthetic oligonucleotide"
ccuguucccacu

SEQ ID NO: 2837 - RNA, 12 nt, Artificial Sequence
  source: /note="Description of Artificial Sequence: Synthetic oligonucleotide"
cccuguucccac

SEQ ID NO: 2838 - RNA, 12 nt, Artificial Sequence
  source: /note="Description of Artificial Sequence: Synthetic oligonucleotide"
ucccuguuccca

SEQ ID NO: 2839 - RNA, 12 nt, Artificial Sequence
  source: /note="Description of Artificial Sequence: Synthetic oligonucleotide"
aucccuguuccc

SEQ ID NO: 2840 - RNA, 12 nt, Artificial Sequence
  source: /note="Description of Artificial Sequence: Synthetic oligonucleotide"
aaucccuguucc

SEQ ID NO: 2841 - RNA, 12 nt, Artificial Sequence
  source: /note="Description of Artificial Sequence: Synthetic oligonucleotide"
aaaucccuguuc

SEQ ID NO: 2842 - RNA, 12 nt, Artificial Sequence
  source: /note="Description of Artificial Sequence: Synthetic oligonucleotide"
aaggacugagaa

SEQ ID NO: 2843 - RNA, 12 nt, Artificial Sequence
  source: /note="Description of Artificial Sequence: Synthetic oligonucleotide"
gugaaggacuga

SEQ ID NO: 2844 - RNA, 12 nt, Artificial Sequence
  source: /note="Description of Artificial Sequence: Synthetic oligonucleotide"
agugaaggacug

SEQ ID NO: 2845 - RNA, 12 nt, Artificial Sequence
  source: /note="Description of Artificial Sequence: Synthetic oligonucleotide"
gagugaaggacu

SEQ ID NO: 2846 - RNA, 12 nt, Artificial Sequence
  source: /note="Description of Artificial Sequence: Synthetic oligonucleotide"
ugagugaaggac

SEQ ID NO: 2847 - RNA, 12 nt, Artificial Sequence
  source: /note="Description of Artificial Sequence: Synthetic oligonucleotide"
uugagugaagga

SEQ ID NO: 2848 - RNA, 12 nt, Artificial Sequence
  source: /note="Description of Artificial Sequence: Synthetic oligonucleotide"
ucuugagugaag

SEQ ID NO: 2849 - RNA, 12 nt, Artificial Sequence
  source: /note="Description of Artificial Sequence: Synthetic oligonucleotide"
uucuugagugaa

SEQ ID NO: 2850 - RNA, 12 nt, Artificial Sequence
  source: /note="Description of Artificial Sequence: Synthetic oligonucleotide"
acuuguucuuga

SEQ ID NO: 2851 - RNA, 12 nt, Artificial Sequence
  source: /note="Description of Artificial Sequence: Synthetic oligonucleotide"
uacuuguucuug

SEQ ID NO: 2852 - RNA, 12 nt, Artificial Sequence
  source: /note="Description of Artificial Sequence: Synthetic oligonucleotide"
cuguccaucaau

SEQ ID NO: 2853 - RNA, 12 nt, Artificial Sequence
  source: /note="Description of Artificial Sequence: Synthetic oligonucleotide"
acuguccaucaa

SEQ ID NO: 2854 - RNA, 12 nt, Artificial Sequence
  source: /note="Description of Artificial Sequence: Synthetic oligonucleotide"
uacuguccauca

SEQ ID NO: 2855 - RNA, 12 nt, Artificial Sequence
  source: /note="Description of Artificial Sequence: Synthetic oligonucleotide"
agucauugcaua

SEQ ID NO: 2856 - RNA, 12 nt, Artificial Sequence
  source: /note="Description of Artificial Sequence: Synthetic oligonucleotide"
gagucauugcau

SEQ ID NO: 2857 - RNA, 12 nt, Artificial Sequence
  source: /note="Description of Artificial Sequence: Synthetic oligonucleotide"
cgagucauugca

SEQ ID NO: 2858 - RNA, 12 nt, Artificial Sequence
  source: /note="Description of Artificial Sequence: Synthetic oligonucleotide"
ucgagucauugc

SEQ ID NO: 2859 - RNA, 12 nt, Artificial Sequence
  source: /note="Description of Artificial Sequence: Synthetic oligonucleotide"
cucugagcucga

SEQ ID NO: 2860 - RNA, 12 nt, Artificial Sequence
  source: /note="Description of Artificial Sequence: Synthetic oligonucleotide"
ccucugagcucg

SEQ ID NO: 2861 - RNA, 12 nt, Artificial Sequence
  source: /note="Description of Artificial Sequence: Synthetic oligonucleotide"
cccucugagcuc

SEQ ID NO: 2862 - RNA, 12 nt, Artificial Sequence
  source: /note="Description of Artificial Sequence: Synthetic oligonucleotide"
acccucugagcu

SEQ ID NO: 2863 - RNA, 12 nt, Artificial Sequence
  source: /note="Description of Artificial Sequence: Synthetic oligonucleotide"
uacccucugagc

SEQ ID NO: 2864 - RNA, 12 nt, Artificial Sequence
  source: /note="Description of Artificial Sequence: Synthetic oligonucleotide"
ucguacccucug

SEQ ID NO: 2865 - RNA, 12 nt, Artificial Sequence
  source: /note="Description of Artificial Sequence: Synthetic oligonucleotide"
cucguacccucu

SEQ ID NO: 2866 - RNA, 12 nt, Artificial Sequence
  source: /note="Description of Artificial Sequence: Synthetic oligonucleotide"
gcucguacccuc

SEQ ID NO: 2867 - RNA, 12 nt, Artificial Sequence
  source: /note="Description of Artificial Sequence: Synthetic oligonucleotide"
agcucguacccu

SEQ ID NO: 2868 - RNA, 12 nt, Artificial Sequence
  source: /note="Description of Artificial Sequence: Synthetic oligonucleotide"
cagcucguaccc

SEQ ID NO: 2869 - RNA, 12 nt, Artificial Sequence
  source: /note="Description of Artificial Sequence: Synthetic oligonucleotide"
gcagcucguacc

SEQ ID NO: 2870 - RNA, 12 nt, Artificial Sequence
  source: /note="Description of Artificial Sequence: Synthetic oligonucleotide"
agcagcucguac

SEQ ID NO: 2871 - RNA, 12 nt, Artificial Sequence
  source: /note="Description of Artificial Sequence: Synthetic oligonucleotide"
uagcagcucgua

SEQ ID NO: 2872 - RNA, 12 nt, Artificial Sequence
  source: /note="Description of Artificial Sequence: Synthetic oligonucleotide"
auagcagcucgu

SEQ ID NO: 2873 - RNA, 12 nt, Artificial Sequence
  source: /note="Description of Artificial Sequence: Synthetic oligonucleotide"
ucagggaacaua

SEQ ID NO: 2874 - RNA, 12 nt, Artificial Sequence
  source: /note="Description of Artificial Sequence: Synthetic oligonucleotide"
cucagggaacau

SEQ ID NO: 2875 - RNA, 12 nt, Artificial Sequence
  source: /note="Description of Artificial Sequence: Synthetic oligonucleotide"
ucucagggaaca

SEQ ID NO: 2876 - RNA, 12 nt, Artificial Sequence
  source: /note="Description of Artificial Sequence: Synthetic oligonucleotide"
gucucagggaac

SEQ ID NO: 2877 - RNA, 12 nt, Artificial Sequence
  source: /note="Description of Artificial Sequence: Synthetic oligonucleotide"
ugucucagggaa

SEQ ID NO: 2878 - RNA, 12 nt, Artificial Sequence
  source: /note="Description of Artificial Sequence: Synthetic oligonucleotide"
augucucaggga

SEQ ID NO: 2879 - RNA, 12 nt, Artificial Sequence
  source: /note="Description of Artificial Sequence: Synthetic oligonucleotide"
aaugucucaggg

SEQ ID NO: 2880 - RNA, 12 nt, Artificial Sequence
  source: /note="Description of Artificial Sequence: Synthetic oligonucleotide"
uaaugucucagg

SEQ ID NO: 2881 - RNA, 12 nt, Artificial Sequence
  source: /note="Description of Artificial Sequence: Synthetic oligonucleotide"
augcccucaucu

SEQ ID NO: 2882 - RNA, 12 nt, Artificial Sequence
  source: /note="Description of Artificial Sequence: Synthetic oligonucleotide"
caugcccucauc

SEQ ID NO: 2883 - RNA, 12 nt, Artificial Sequence
  source: /note="Description of Artificial Sequence: Synthetic oligonucleotide"
gcaugcccucau

SEQ ID NO: 2884 - RNA, 12 nt, Artificial Sequence
  source: /note="Description of Artificial Sequence: Synthetic oligonucleotide"
ugcaugcccuca

SEQ ID NO: 2885 - RNA, 12 nt, Artificial Sequence
  source: /note="Description of Artificial Sequence: Synthetic oligonucleotide"
cugcaugcccuc

SEQ ID NO: 2886 - RNA, 12 nt, Artificial Sequence
  source: /note="Description of Artificial Sequence: Synthetic oligonucleotide"
ucugcaugcccu

SEQ ID NO: 2887 - RNA, 12 nt, Artificial Sequence
  source: /note="Description of Artificial Sequence: Synthetic oligonucleotide"
aucugcaugccc

SEQ ID NO: 2888 - RNA, 12 nt, Artificial Sequence
  source: /note="Description of Artificial Sequence: Synthetic oligonucleotide"
gaucugcaugcc

SEQ ID NO: 2889 - RNA, 12 nt, Artificial Sequence
  source: /note="Description of Artificial Sequence: Synthetic oligonucleotide"
ggaucugcaugc

SEQ ID NO: 2890 - RNA, 12 nt, Artificial Sequence
  source: /note="Description of Artificial Sequence: Synthetic oligonucleotide"
gggaucugcaug

SEQ ID NO: 2891 - RNA, 12 nt, Artificial Sequence
  source: /note="Description of Artificial Sequence: Synthetic oligonucleotide"
ugggaucugcau

SEQ ID NO: 2892 - RNA, 12 nt, Artificial Sequence
  source: /note="Description of Artificial Sequence: Synthetic oligonucleotide"
augggaucugca

SEQ ID NO: 2893 - RNA, 12 nt, Artificial Sequence
  source: /note="Description of Artificial Sequence: Synthetic oligonucleotide"
gaugggaucugc

SEQ ID NO: 2894 - RNA, 12 nt, Artificial Sequence
  source: /note="Description of Artificial Sequence: Synthetic oligonucleotide"
uagaugggaucu

SEQ ID NO: 2895 - RNA, 12 nt, Artificial Sequence
  source: /note="Description of Artificial Sequence: Synthetic oligonucleotide"
uguguagauggg

SEQ ID NO: 2896 - RNA, 12 nt, Artificial Sequence
  source: /note="Description of Artificial Sequence: Synthetic oligonucleotide"
cuguguagaugg

SEQ ID NO: 2897 - RNA, 12 nt, Artificial Sequence
  source: /note="Description of Artificial Sequence: Synthetic oligonucleotide"
acuguguagaug

SEQ ID NO: 2898 - RNA, 12 nt, Artificial Sequence
  source: /note="Description of Artificial Sequence: Synthetic oligonucleotide"
aacuguguagau

SEQ ID NO: 2899 - RNA, 12 nt, Artificial Sequence
  source: /note="Description of Artificial Sequence: Synthetic oligonucleotide"
augagcagcauc

SEQ ID NO: 2900 - RNA, 12 nt, Artificial Sequence
  source: /note="Description of Artificial Sequence: Synthetic oligonucleotide"
gaugagcagcau

SEQ ID NO: 2901 - RNA, 12 nt, Artificial Sequence
  source: /note="Description of Artificial Sequence: Synthetic oligonucleotide"
ggaugagcagca

SEQ ID NO: 2902 - RNA, 12 nt, Artificial Sequence
  source: /note="Description of Artificial Sequence: Synthetic oligonucleotide"
gggaugagcagc

SEQ ID NO: 2903 - RNA, 12 nt, Artificial Sequence
  source: /note="Description of Artificial Sequence: Synthetic oligonucleotide"
ugggaugagcag

SEQ ID NO: 2904 - RNA, 12 nt, Artificial Sequence
  source: /note="Description of Artificial Sequence: Synthetic oligonucleotide"
gugggaugagca

SEQ ID NO: 2905 - RNA, 12 nt, Artificial Sequence
  source: /note="Description of Artificial Sequence: Synthetic oligonucleotide"
agugggaugagc

SEQ ID NO: 2906 - RNA, 12 nt, Artificial Sequence
  source: /note="Description of Artificial Sequence: Synthetic oligonucleotide"
uagugggaugag

SEQ ID NO: 2907 - RNA, 12 nt, Artificial Sequence
  source: /note="Description of Artificial Sequence: Synthetic oligonucleotide"
uuagugggauga

SEQ ID NO: 2908 - RNA, 12 nt, Artificial Sequence
  source: /note="Description of Artificial Sequence: Synthetic oligonucleotide"
auuagugggaug

SEQ ID NO: 2909 - RNA, 12 nt, Artificial Sequence
  source: /note="Description of Artificial Sequence: Synthetic oligonucleotide"
cauuagugggau

SEQ ID NO: 2910 - RNA, 12 nt, Artificial Sequence
  source: /note="Description of Artificial Sequence: Synthetic oligonucleotide"
acauuaguggga

SEQ ID NO: 2911 - RNA, 12 nt, Artificial Sequence
  source: /note="Description of Artificial Sequence: Synthetic oligonucleotide"
gacauuaguggg

SEQ ID NO: 2912 - RNA, 12 nt, Artificial Sequence
  source: /note="Description of Artificial Sequence: Synthetic oligonucleotide"
ggacauuagugg

SEQ ID NO: 2913 - RNA, 12 nt, Artificial Sequence
  source: /note="Description of Artificial Sequence: Synthetic oligonucleotide"
uggacauuagug

SEQ ID NO: 2914 - RNA, 12 nt, Artificial Sequence
  source: /note="Description of Artificial Sequence: Synthetic oligonucleotide"
cuggacauuagu

SEQ ID NO: 2915 - RNA, 12 nt, Artificial Sequence
  source: /note="Description of Artificial Sequence: Synthetic oligonucleotide"
gcuggacauuag

SEQ ID NO: 2916 - RNA, 12 nt, Artificial Sequence
  source: /note="Description of Artificial Sequence: Synthetic oligonucleotide"
cgcuggacauua

SEQ ID NO: 2917 - RNA, 12 nt, Artificial Sequence
  source: /note="Description of Artificial Sequence: Synthetic oligonucleotide"
ucagccaaacgc

SEQ ID NO: 2918 - RNA, 12 nt, Artificial Sequence
  source: /note="Description of Artificial Sequence: Synthetic oligonucleotide"
uucagccaaacg

SEQ ID NO: 2919 - RNA, 12 nt, Artificial Sequence
  source: /note="Description of Artificial Sequence: Synthetic oligonucleotide"
guucagccaaac

SEQ ID NO: 2920 - RNA, 12 nt, Artificial Sequence
  source: /note="Description of Artificial Sequence: Synthetic oligonucleotide"
gguucagccaaa

SEQ ID NO: 2921 - RNA, 12 nt, Artificial Sequence
  source: /note="Description of Artificial Sequence: Synthetic oligonucleotide"
ugguucagccaa

SEQ ID NO: 2922 - RNA, 12 nt, Artificial Sequence
  source: /note="Description of Artificial Sequence: Synthetic oligonucleotide"
augguucagcca

SEQ ID NO: 2923 - RNA, 12 nt, Artificial Sequence
  source: /note="Description of Artificial Sequence: Synthetic oligonucleotide"
gaugguucagcc

SEQ ID NO: 2924 - RNA, 12 nt, Artificial Sequence
  source: /note="Description of Artificial Sequence: Synthetic oligonucleotide"
ugaugguucagc

SEQ ID NO: 2925 - RNA, 12 nt, Artificial Sequence
  source: /note="Description of Artificial Sequence: Synthetic oligonucleotide"
gugaugguucag

SEQ ID NO: 2926 - RNA, 12 nt, Artificial Sequence
  source: /note="Description of Artificial Sequence: Synthetic oligonucleotide"
ugugaugguuca

SEQ ID NO: 2927 - RNA, 12 nt, Artificial Sequence
  source: /note="Description of Artificial Sequence: Synthetic oligonucleotide"
cugugaugguuc

SEQ ID NO: 2928 - RNA, 12 nt, Artificial Sequence
  source: /note="Description of Artificial Sequence: Synthetic oligonucleotide"
ucugugaugguu

SEQ ID NO: 2929 - RNA, 12 nt, Artificial Sequence
  source: /note="Description of Artificial Sequence: Synthetic oligonucleotide"
aucugugauggu

SEQ ID NO: 2930 - RNA, 12 nt, Artificial Sequence
  source: /note="Description of Artificial Sequence: Synthetic oligonucleotide"
caucugugaugg

SEQ ID NO: 2931 - RNA, 12 nt, Artificial Sequence
  source: /note="Description of Artificial Sequence: Synthetic oligonucleotide"
gcaucugugaug

SEQ ID NO: 2932 - RNA, 12 nt, Artificial Sequence
  source: /note="Description of Artificial Sequence: Synthetic oligonucleotide"
agcaucugugau

SEQ ID NO: 2933 - RNA, 12 nt, Artificial Sequence
  source: /note="Description of Artificial Sequence: Synthetic oligonucleotide"
cagcaucuguga

SEQ ID NO: 2934 - RNA, 12 nt, Artificial Sequence
  source: /note="Description of Artificial Sequence: Synthetic oligonucleotide"
ucagcaucugug

SEQ ID NO: 2935 - RNA, 12 nt, Artificial Sequence
  source: /note="Description of Artificial Sequence: Synthetic oligonucleotide"
uucagcaucugu

SEQ ID NO: 2936 - RNA, 12 nt, Artificial Sequence
  source: /note="Description of Artificial Sequence: Synthetic oligonucleotide"
uuucagcaucug

SEQ ID NO: 2937 - RNA, 12 nt, Artificial Sequence
  source: /note="Description of Artificial Sequence: Synthetic oligonucleotide"
uguuucagcauc

SEQ ID NO: 2938 - RNA, 12 nt, Artificial Sequence
  source: /note="Description of Artificial Sequence: Synthetic oligonucleotide"
auguuucagcau

SEQ ID NO: 2939 - RNA, 12 nt, Artificial Sequence
  source: /note="Description of Artificial Sequence: Synthetic oligonucleotide"
ugcauguuucag

SEQ ID NO: 2940 - RNA, 12 nt, Artificial Sequence
  source: /note="Description of Artificial Sequence: Synthetic oligonucleotide"
cugcauguuuca

SEQ ID NO: 2941 - RNA, 12 nt, Artificial Sequence
  source: /note="Description of Artificial Sequence: Synthetic oligonucleotide"
acugcauguuuc

SEQ ID NO: 2942 - RNA, 12 nt, Artificial Sequence
  source: /note="Description of Artificial Sequence: Synthetic oligonucleotide"
aacugcauguuu

SEQ ID NO: 2943 - RNA, 12 nt, Artificial Sequence
  source: /note="Description of Artificial Sequence: Synthetic oligonucleotide"
caacugcauguu

SEQ ID NO: 2944 - RNA, 12 nt, Artificial Sequence
  source: /note="Description of Artificial Sequence: Synthetic oligonucleotide"
acaacugcaugu

SEQ ID NO: 2945 - RNA, 12 nt, Artificial Sequence
  source: /note="Description of Artificial Sequence: Synthetic oligonucleotide"
uacaacugcaug

SEQ ID NO: 2946 - RNA, 12 nt, Artificial Sequence
  source: /note="Description of Artificial Sequence: Synthetic oligonucleotide"
uuacaacugcau

SEQ ID NO: 2947 - RNA, 12 nt, Artificial Sequence
  source: /note="Description of Artificial Sequence: Synthetic oligonucleotide"
uuuacaacugca

SEQ ID NO: 2948 - RNA, 12 nt, Artificial Sequence
  source: /note="Description of Artificial Sequence: Synthetic oligonucleotide"
guuuacaacugc

SEQ ID NO: 2949 - RNA, 12 nt, Artificial Sequence
  source: /note="Description of Artificial Sequence: Synthetic oligonucleotide"
aguuuacaacug

SEQ ID NO: 2950 - RNA, 12 nt, Artificial Sequence
  source: /note="Description of Artificial Sequence: Synthetic oligonucleotide"
aaguuuacaacu

SEQ ID NO: 2951 - RNA, 12 nt, Artificial Sequence
  source: /note="Description of Artificial Sequence: Synthetic oligonucleotide"
caaguuuacaac

SEQ ID NO: 2952 - RNA, 12 nt, Artificial Sequence
  source: /note="Description of Artificial Sequence: Synthetic oligonucleotide"
ucaaguuuacaa

SEQ ID NO: 2953 - RNA, 12 nt, Artificial Sequence
  source: /note="Description of Artificial Sequence: Synthetic oligonucleotide"
aucaaguuuaca

SEQ ID NO: 2954 - RNA, 12 nt, Artificial Sequence
  source: /note="Description of Artificial Sequence: Synthetic oligonucleotide"
aaucaaguuuac

SEQ ID NO: 2955 - RNA, 12 nt, Artificial Sequence
  source: /note="Description of Artificial Sequence: Synthetic oligonucleotide"
uaaucaaguuua

SEQ ID NO: 2956 - RNA, 12 nt, Artificial Sequence
  source: /note="Description of Artificial Sequence: Synthetic oligonucleotide"
uuaaucaaguuu

SEQ ID NO: 2957 - RNA, 12 nt, Artificial Sequence
  source: /note="Description of Artificial Sequence: Synthetic oligonucleotide"
guuaaucaaguu

SEQ ID NO: 2958 - RNA, 12 nt, Artificial Sequence
  source: /note="Description of Artificial Sequence: Synthetic oligonucleotide"
aguuaaucaagu

SEQ ID NO: 2959 - RNA, 12 nt, Artificial Sequence
  source: /note="Description of Artificial Sequence: Synthetic oligonucleotide"
uaguuaaucaag

SEQ ID NO: 2960 - RNA, 12 nt, Artificial Sequence
  source: /note="Description of Artificial Sequence: Synthetic oligonucleotide"
auaguuaaucaa

SEQ ID NO: 2961 - RNA, 12 nt, Artificial Sequence
  source: /note="Description of Artificial Sequence: Synthetic oligonucleotide"
gauaguuaauca

SEQ ID NO: 2962 - RNA, 12 nt, Artificial Sequence
  source: /note="Description of Artificial Sequence: Synthetic oligonucleotide"
ugauaguuaauc

SEQ ID NO: 2963 - RNA, 12 nt, Artificial Sequence
  source: /note="Description of Artificial Sequence: Synthetic oligonucleotide"
uugauaguuaau

SEQ ID NO: 2964 - RNA, 12 nt, Artificial Sequence
  source: /note="Description of Artificial Sequence: Synthetic oligonucleotide"
cuugauaguuaa

SEQ ID NO: 2965 - RNA, 12 nt, Artificial Sequence
  source: /note="Description of Artificial Sequence: Synthetic oligonucleotide"
ucuugauaguua

SEQ ID NO: 2966 - RNA, 12 nt, Artificial Sequence
  source: /note="Description of Artificial Sequence: Synthetic oligonucleotide"
aucuugauaguu

SEQ ID NO: 2967 - RNA, 12 nt, Artificial Sequence
  source: /note="Description of Artificial Sequence: Synthetic oligonucleotide"
ucaucuugauag

SEQ ID NO: 2968 - RNA, 12 nt, Artificial Sequence
  source: /note="Description of Artificial Sequence: Synthetic oligonucleotide"
aucaucuugaua

SEQ ID NO: 2969 - RNA, 12 nt, Artificial Sequence
  source: /note="Description of Artificial Sequence: Synthetic oligonucleotide"
guguggcaaguu

SEQ ID NO: 2970 - RNA, 12 nt, Artificial Sequence
  source: /note="Description of Artificial Sequence: Synthetic oligonucleotide"
cguguggcaagu

SEQ ID NO: 2971 - RNA, 12 nt, Artificial Sequence
  source: /note="Description of Artificial Sequence: Synthetic oligonucleotide"
acguguggcaag

SEQ ID NO: 2972 - RNA, 12 nt, Artificial Sequence
  source: /note="Description of Artificial Sequence: Synthetic oligonucleotide"
cacguguggcaa

SEQ ID NO: 2973 - RNA, 12 nt, Artificial Sequence
  source: /note="Description of Artificial Sequence: Synthetic oligonucleotide"
gcacguguggca

SEQ ID NO: 2974 - RNA, 12 nt, Artificial Sequence
  source: /note="Description of Artificial Sequence: Synthetic oligonucleotide"
ugcacguguggc

SEQ ID NO: 2975 - RNA, 12 nt, Artificial Sequence
  source: /note="Description of Artificial Sequence: Synthetic oligonucleotide"
uugcacgugugg

SEQ ID NO: 2976 - RNA, 12 nt, Artificial Sequence
  source: /note="Description of Artificial Sequence: Synthetic oligonucleotide"
auugcacgugug

SEQ ID NO: 2977 - RNA, 12 nt, Artificial Sequence
  source: /note="Description of Artificial Sequence: Synthetic oligonucleotide"
uucagggauugc

SEQ ID NO: 2978 - RNA, 12 nt, Artificial Sequence
  source: /note="Description of Artificial Sequence: Synthetic oligonucleotide"
guucagggauug

SEQ ID NO: 2979 - RNA, 12 nt, Artificial Sequence
  source: /note="Description of Artificial Sequence: Synthetic oligonucleotide"
aguucagggauu

SEQ ID NO: 2980 - RNA, 12 nt, Artificial Sequence
  source: /note="Description of Artificial Sequence: Synthetic oligonucleotide"
caguucagggau

SEQ ID NO: 2981 - RNA, 12 nt, Artificial Sequence
  source: /note="Description of Artificial Sequence: Synthetic oligonucleotide"
ucaguucaggga

SEQ ID NO: 2982 - RNA, 12 nt, Artificial Sequence
  source: /note="Description of Artificial Sequence: Synthetic oligonucleotide"
gucaguucaggg

SEQ ID NO: 2983 - RNA, 12 nt, Artificial Sequence
  source: /note="Description of Artificial Sequence: Synthetic oligonucleotide"
ugucaguucagg

SEQ ID NO: 2984 - RNA, 12 nt, Artificial Sequence
  source: /note="Description of Artificial Sequence: Synthetic oligonucleotide"
uugucaguucag

SEQ ID NO: 2985 - RNA, 12 nt, Artificial Sequence
  source: /note="Description of Artificial Sequence: Synthetic oligonucleotide"
uuugucaguuca

SEQ ID NO: 2986 - RNA, 12 nt, Artificial Sequence
  source: /note="Description of Artificial Sequence: Synthetic oligonucleotide"
uuuugucaguuc

SEQ ID NO: 2987 - RNA, 12 nt, Artificial Sequence
  source: /note="Description of Artificial Sequence: Synthetic oligonucleotide"
guuuugucaguu

SEQ ID NO: 2988 - RNA, 12 nt, Artificial Sequence
  source: /note="Description of Artificial Sequence: Synthetic oligonucleotide"
aguuuugucagu

SEQ ID NO: 2989 - RNA, 12 nt, Artificial Sequence
  source: /note="Description of Artificial Sequence: Synthetic oligonucleotide"
caguuuugucag

SEQ ID NO: 2990 - RNA, 12 nt, Artificial Sequence
  source: /note="Description of Artificial Sequence: Synthetic oligonucleotide"
gcaguuuuguca

SEQ ID NO: 2991 - RNA, 12 nt, Artificial Sequence
  source: /note="Description of Artificial Sequence: Synthetic oligonucleotide"
agcaguuuuguc

SEQ ID NO: 2992 - RNA, 12 nt, Artificial Sequence
  source: /note="Description of Artificial Sequence: Synthetic oligonucleotide"
uagcaguuuugu

SEQ ID NO: 2993 - RNA, 12 nt, Artificial Sequence
  source: /note="Description of Artificial Sequence: Synthetic oligonucleotide"
uuagcaguuuug

SEQ ID NO: 2994 - RNA, 12 nt, Artificial Sequence
  source: /note="Description of Artificial Sequence: Synthetic oligonucleotide"
uuuagcaguuuu

SEQ ID NO: 2995 - RNA, 12 nt, Artificial Sequence
  source: /note="Description of Artificial Sequence: Synthetic oligonucleotide"
ccaccugguccu

SEQ ID NO: 2996 - RNA, 12 nt, Artificial Sequence
  source: /note="Description of Artificial Sequence: Synthetic oligonucleotide"
accaccuggucc

SEQ ID NO: 2997 - RNA, 12 nt, Artificial Sequence
  source: /note="Description of Artificial Sequence: Synthetic oligonucleotide"
caccaccugguc

SEQ ID NO: 2998 - RNA, 12 nt, Artificial Sequence
  source: /note="Description of Artificial Sequence: Synthetic oligonucleotide"
ccaccaccuggu

SEQ ID NO: 2999 - RNA, 12 nt, Artificial Sequence
  source: /note="Description of Artificial Sequence: Synthetic oligonucleotide"
accaccaccugg

SEQ ID NO: 3000 - RNA, 12 nt, Artificial Sequence
  source: /note="Description of Artificial Sequence: Synthetic oligonucleotide"
aaccaccaccug

SEQ ID NO: 3001 - RNA, 12 nt, Artificial Sequence
  source: /note="Description of Artificial Sequence: Synthetic oligonucleotide"
uaaccaccaccu

SEQ ID NO: 3002 - RNA, 12 nt, Artificial Sequence
  source: /note="Description of Artificial Sequence: Synthetic oligonucleotide"
uuaaccaccacc

SEQ ID NO: 3003 - RNA, 12 nt, Artificial Sequence
  source: /note="Description of Artificial Sequence: Synthetic oligonucleotide"
auuaaccaccac

SEQ ID NO: 3004 - RNA, 12 nt, Artificial Sequence
  source: /note="Description of Artificial Sequence: Synthetic oligonucleotide"
uauuaaccacca

SEQ ID NO: 3005 - RNA, 12 nt, Artificial Sequence
  source: /note="Description of Artificial Sequence: Synthetic oligonucleotide"
auggaccauaac

SEQ ID NO: 3006 - RNA, 12 nt, Artificial Sequence
  source: /note="Description of Artificial Sequence: Synthetic oligonucleotide"
cugauggaccau

SEQ ID NO: 3007 - RNA, 12 nt, Artificial Sequence
  source: /note="Description of Artificial Sequence: Synthetic oligonucleotide"
gcugauggacca

SEQ ID NO: 3008 - RNA, 12 nt, Artificial Sequence
  source: /note="Description of Artificial Sequence: Synthetic oligonucleotide"
agcugauggacc

SEQ ID NO: 3009 - RNA, 12 nt, Artificial Sequence
  source: /note="Description of Artificial Sequence: Synthetic oligonucleotide"
aagcugauggac

SEQ ID NO: 3010 - RNA, 12 nt, Artificial Sequence
  source: /note="Description of Artificial Sequence: Synthetic oligonucleotide"
aaagcugaugga

SEQ ID NO: 3011 - RNA, 12 nt, Artificial Sequence
  source: /note="Description of Artificial Sequence: Synthetic oligonucleotide"
gaaagcugaugg

SEQ ID NO: 3012 - RNA, 12 nt, Artificial Sequence
  source: /note="Description of Artificial Sequence: Synthetic oligonucleotide"
agaaagcugaug

SEQ ID NO: 3013 - RNA, 12 nt, Artificial Sequence
  source: /note="Description of Artificial Sequence: Synthetic oligonucleotide"
uagaaagcugau

SEQ ID NO: 3014 - RNA, 12 nt, Artificial Sequence
  source: /note="Description of Artificial Sequence: Synthetic oligonucleotide"
uuagaaagcuga

SEQ ID NO: 3015 - RNA, 12 nt, Artificial Sequence
  source: /note="Description of Artificial Sequence: Synthetic oligonucleotide"
uuuagaaagcug

SEQ ID NO: 3016 - RNA, 12 nt, Artificial Sequence
  source: /note="Description of Artificial Sequence: Synthetic oligonucleotide"
ucuggaagcuuc

SEQ ID NO: 3017 - RNA, 12 nt, Artificial Sequence
  source: /note="Description of Artificial Sequence: Synthetic oligonucleotide"
gucuggaagcuu

SEQ ID NO: 3018 - RNA, 12 nt, Artificial Sequence
  source: /note="Description of Artificial Sequence: Synthetic oligonucleotide"
ugucuggaagcu

SEQ ID NO: 3019 - RNA, 12 nt, Artificial Sequence
  source: /note="Description of Artificial Sequence: Synthetic oligonucleotide"
gugucuggaagc

SEQ ID NO: 3020 - RNA, 12 nt, Artificial Sequence
  source: /note="Description of Artificial Sequence: Synthetic oligonucleotide"
cgugucuggaag

SEQ ID NO: 3021 - RNA, 12 nt, Artificial Sequence
  source: /note="Description of Artificial Sequence: Synthetic oligonucleotide"
gcgugucuggaa

SEQ ID NO: 3022 - RNA, 12 nt, Artificial Sequence
  source: /note="Description of Artificial Sequence: Synthetic oligonucleotide"
agcgugucugga

SEQ ID NO: 3023 - RNA, 12 nt, Artificial Sequence
  source: /note="Description of Artificial Sequence: Synthetic oligonucleotide"
uagcgugucugg

SEQ ID NO: 3024 - RNA, 12 nt, Artificial Sequence
  source: /note="Description of Artificial Sequence: Synthetic oligonucleotide"
auagcgugucug

SEQ ID NO: 3025 - RNA, 12 nt, Artificial Sequence
  source: /note="Description of Artificial Sequence: Synthetic oligonucleotide"
gauagcgugucu

SEQ ID NO: 3026 - RNA, 12 nt, Artificial Sequence
  source: /note="Description of Artificial Sequence: Synthetic oligonucleotide"
ugauagcguguc

SEQ ID NO: 3027 - RNA, 12 nt, Artificial Sequence
  source: /note="Description of Artificial Sequence: Synthetic oligonucleotide"
augauagcgugu

SEQ ID NO: 3028 - RNA, 12 nt, Artificial Sequence
  source: /note="Description of Artificial Sequence: Synthetic oligonucleotide"
caugauagcgug

SEQ ID NO: 3029 - RNA, 12 nt, Artificial Sequence
  source: /note="Description of Artificial Sequence: Synthetic oligonucleotide"
gcaugauagcgu

SEQ ID NO: 3030 - RNA, 12 nt, Artificial Sequence
  source: /note="Description of Artificial Sequence: Synthetic oligonucleotide"
cgcaugauagcg

SEQ ID NO: 3031 - RNA, 12 nt, Artificial Sequence
  source: /note="Description of Artificial Sequence: Synthetic oligonucleotide"
acgcaugauagc

SEQ ID NO: 3032 - RNA, 12 nt, Artificial Sequence
  source: /note="Description of Artificial Sequence: Synthetic oligonucleotide"
aacgcaugauag

SEQ ID NO: 3033 - RNA, 12 nt, Artificial Sequence
  source: /note="Description of Artificial Sequence: Synthetic oligonucleotide"
gaacgcaugaua

SEQ ID NO: 3034 - RNA, 12 nt, Artificial Sequence
  source: /note="Description of Artificial Sequence: Synthetic oligonucleotide"
agaacgcaugau

SEQ ID NO: 3035 - RNA, 12 nt, Artificial Sequence
  source: /note="Description of Artificial Sequence: Synthetic oligonucleotide"
gagaacgcauga

SEQ ID NO: 3036 - RNA, 12 nt, Artificial Sequence
  source: /note="Description of Artificial Sequence: Synthetic oligonucleotide"
ggagaacgcaug

SEQ ID NO: 3037 - RNA, 12 nt, Artificial Sequence
  source: /note="Description of Artificial Sequence: Synthetic oligonucleotide"
aggagaacgcau

SEQ ID NO: 3038 - RNA, 12 nt, Artificial Sequence
  source: /note="Description of Artificial Sequence: Synthetic oligonucleotide"
acaccaucugag

SEQ ID NO: 3039 - RNA, 12 nt, Artificial Sequence
  source: /note="Description of Artificial Sequence: Synthetic oligonucleotide"
gacaccaucuga

SEQ ID NO: 3040 - RNA, 12 nt, Artificial Sequence
  source: /note="Description of Artificial Sequence: Synthetic oligonucleotide"
agacaccaucug

SEQ ID NO: 3041 - RNA, 12 nt, Artificial Sequence
  source: /note="Description of Artificial Sequence: Synthetic oligonucleotide"
cagacaccaucu

SEQ ID NO: 3042 - RNA, 12 nt, Artificial Sequence
  source: /note="Description of Artificial Sequence: Synthetic oligonucleotide"
gcagacaccauc

SEQ ID NO: 3043 - RNA, 12 nt, Artificial Sequence
  source: /note="Description of Artificial Sequence: Synthetic oligonucleotide"
agcagacaccau

SEQ ID NO: 3044 - RNA, 12 nt, Artificial Sequence
  source: /note="Description of Artificial Sequence: Synthetic oligonucleotide"
uagcagacacca

SEQ ID NO: 3045 - RNA, 12 nt, Artificial Sequence
  source: /note="Description of Artificial Sequence: Synthetic oligonucleotide"
guacaauagcag

SEQ ID NO: 3046 - RNA, 12 nt, Artificial Sequence
  source: /note="Description of Artificial Sequence: Synthetic oligonucleotide"
cguacaauagca

SEQ ID NO: 3047 - RNA, 12 nt, Artificial Sequence
  source: /note="Description of Artificial Sequence: Synthetic oligonucleotide"
acguacaauagc

SEQ ID NO: 3048 - RNA, 12 nt, Artificial Sequence
  source: /note="Description of Artificial Sequence: Synthetic oligonucleotide"
uacguacaauag

SEQ ID NO: 3049 - RNA, 12 nt, Artificial Sequence
  source: /note="Description of Artificial Sequence: Synthetic oligonucleotide"
ugguacguacaa

SEQ ID NO: 3050 - RNA, 12 nt, Artificial Sequence
  source: /note="Description of Artificial Sequence: Synthetic oligonucleotide"
augguacguaca

SEQ ID NO: 3051 - RNA, 12 nt, Artificial Sequence
  source: /note="Description of Artificial Sequence: Synthetic oligonucleotide"
caugguacguac

SEQ ID NO: 3052 - RNA, 12 nt, Artificial Sequence
  source: /note="Description of Artificial Sequence: Synthetic oligonucleotide"
gcaugguacgua

SEQ ID NO: 3053 - RNA, 12 nt, Artificial Sequence
  source: /note="Description of Artificial Sequence: Synthetic oligonucleotide"
ugcaugguacgu

SEQ ID NO: 3054 - RNA, 12 nt, Artificial Sequence
  source: /note="Description of Artificial Sequence: Synthetic oligonucleotide"
cugcaugguacg

SEQ ID NO: 3055 - RNA, 12 nt, Artificial Sequence
  source: /note="Description of Artificial Sequence: Synthetic oligonucleotide"
ucugcaugguac

SEQ ID NO: 3056 - RNA, 12 nt, Artificial Sequence
  source: /note="Description of Artificial Sequence: Synthetic oligonucleotide"
uucugcauggua

SEQ ID NO: 3057 - RNA, 12 nt, Artificial Sequence
  source: /note="Description of Artificial Sequence: Synthetic oligonucleotide"
auucugcauggu

SEQ ID NO: 3058 - RNA, 12 nt, Artificial Sequence
  source: /note="Description of Artificial Sequence: Synthetic oligonucleotide"
guauucugcaug

SEQ ID NO: 3059 - RNA, 12 nt, Artificial Sequence
  source: /note="Description of Artificial Sequence: Synthetic oligonucleotide"
uguauucugcau

SEQ ID NO: 3060 - RNA, 12 nt, Artificial Sequence
  source: /note="Description of Artificial Sequence: Synthetic oligonucleotide"
uuguauucugca

SEQ ID NO: 3061 - RNA, 12 nt, Artificial Sequence
  source: /note="Description of Artificial Sequence: Synthetic oligonucleotide"
uuuguauucugc

SEQ ID NO: 3062 - RNA, 12 nt, Artificial Sequence
  source: /note="Description of Artificial Sequence: Synthetic oligonucleotide"
auuuguauucug

SEQ ID NO: 3063 - RNA, 12 nt, Artificial Sequence
  source: /note="Description of Artificial Sequence: Synthetic oligonucleotide"
cauuuguauucu

SEQ ID NO: 3064 - RNA, 12 nt, Artificial Sequence
  source: /note="Description of Artificial Sequence: Synthetic oligonucleotide"
ucauuuguauuc

SEQ ID NO: 3065 - RNA, 12 nt, Artificial Sequence
  source: /note="Description of Artificial Sequence: Synthetic oligonucleotide"
aucauuuguauu

SEQ ID NO: 3066 - RNA, 12 nt, Artificial Sequence
  source: /note="Description of Artificial Sequence: Synthetic oligonucleotide"
caucauuuguau

SEQ ID NO: 3067 - RNA, 12 nt, Artificial Sequence
  source: /note="Description of Artificial Sequence: Synthetic oligonucleotide"
acaucauuugua

SEQ ID NO: 3068 - RNA, 12 nt, Artificial Sequence
  source: /note="Description of Artificial Sequence: Synthetic oligonucleotide"
uacaucauuugu

SEQ ID NO: 3069 - RNA, 12 nt, Artificial Sequence
  source: /note="Description of Artificial Sequence: Synthetic oligonucleotide"
cuacaucauuug

SEQ ID NO: 3070 - RNA, 12 nt, Artificial Sequence
  source: /note="Description of Artificial Sequence: Synthetic oligonucleotide"
ucuacaucauuu

SEQ ID NO: 3071 - RNA, 12 nt, Artificial Sequence
  source: /note="Description of Artificial Sequence: Synthetic oligonucleotide"
uucuacaucauu

SEQ ID NO: 3072 - RNA, 12 nt, Artificial Sequence
  source: /note="Description of Artificial Sequence: Synthetic oligonucleotide"
gucccagcggua

SEQ ID NO: 3073 - RNA, 12 nt, Artificial Sequence
  source: /note="Description of Artificial Sequence: Synthetic oligonucleotide"
ggucccagcggu

SEQ ID NO: 3074 - RNA, 12 nt, Artificial Sequence
  source: /note="Description of Artificial Sequence: Synthetic oligonucleotide"
aggucccagcgg

SEQ ID NO: 3075 - RNA, 12 nt, Artificial Sequence
  source: /note="Description of Artificial Sequence: Synthetic oligonucleotide"
aaggucccagcg

SEQ ID NO: 3076 - RNA, 12 nt, Artificial Sequence
  source: /note="Description of Artificial Sequence: Synthetic oligonucleotide"
caaggucccagc

SEQ ID NO: 3077 - RNA, 12 nt, Artificial Sequence
  source: /note="Description of Artificial Sequence: Synthetic oligonucleotide"
gcaaggucccag

SEQ ID NO: 3078 - RNA, 12 nt, Artificial Sequence
  source: /note="Description of Artificial Sequence: Synthetic oligonucleotide"
ugcaagguccca

SEQ ID NO: 3079 - RNA, 12 nt, Artificial Sequence
  source: /note="Description of Artificial Sequence: Synthetic oligonucleotide"
augcaagguccc

SEQ ID NO: 3080 - RNA, 12 nt, Artificial Sequence
  source: /note="Description of Artificial Sequence: Synthetic oligonucleotide"
uaugcaaggucc

SEQ ID NO: 3081 - RNA, 12 nt, Artificial Sequence
  source: /note="Description of Artificial Sequence: Synthetic oligonucleotide"
uuaugcaagguc

SEQ ID NO: 3082 - RNA, 12 nt, Artificial Sequence
  source: /note="Description of Artificial Sequence: Synthetic oligonucleotide"
guuaugcaaggu

SEQ ID NO: 3083 - RNA, 12 nt, Artificial Sequence
  source: /note="Description of Artificial Sequence: Synthetic oligonucleotide"
gguuaugcaagg

SEQ ID NO: 3084 - RNA, 12 nt, Artificial Sequence
  source: /note="Description of Artificial Sequence: Synthetic oligonucleotide"
agguuaugcaag

SEQ ID NO: 3085 - RNA, 12 nt, Artificial Sequence
  source: /note="Description of Artificial Sequence: Synthetic oligonucleotide"
aagguuaugcaa

SEQ ID NO: 3086 - RNA, 12 nt, Artificial Sequence
  source: /note="Description of Artificial Sequence: Synthetic oligonucleotide"
aaagguuaugca

SEQ ID NO: 3087 - RNA, 12 nt, Artificial Sequence
  source: /note="Description of Artificial Sequence: Synthetic oligonucleotide"
gaaagguuaugc

SEQ ID NO: 3088 - RNA, 12 nt, Artificial Sequence
  source: /note="Description of Artificial Sequence: Synthetic oligonucleotide"
ggaaagguuaug

SEQ ID NO: 3089 - RNA, 12 nt, Artificial Sequence
  source: /note="Description of Artificial Sequence: Synthetic oligonucleotide"
cagacuuaaaga

SEQ ID NO: 3090 - RNA, 12 nt, Artificial Sequence
  source: /note="Description of Artificial Sequence: Synthetic oligonucleotide"
ccagacuuaaag

SEQ ID NO: 3091 - RNA, 12 nt, Artificial Sequence
  source: /note="Description of Artificial Sequence: Synthetic oligonucleotide"
agggcaggaaug

SEQ ID NO: 3092 - RNA, 12 nt, Artificial Sequence
  source: /note="Description of Artificial Sequence: Synthetic oligonucleotide"
cagggcaggaau

SEQ ID NO: 3093 - RNA, 12 nt, Artificial Sequence
  source: /note="Description of Artificial Sequence: Synthetic oligonucleotide"
ccagggcaggaa

SEQ ID NO: 3094 - RNA, 12 nt, Artificial Sequence
  source: /note="Description of Artificial Sequence: Synthetic oligonucleotide"
accagggcagga

SEQ ID NO: 3095 - RNA, 12 nt, Artificial Sequence
  source: /note="Description of Artificial Sequence: Synthetic oligonucleotide"
caccagggcagg

SEQ ID NO: 3096 - RNA, 12 nt, Artificial Sequence
  source: /note="Description of Artificial Sequence: Synthetic oligonucleotide"
ucaccagggcag

SEQ ID NO: 3097 - RNA, 12 nt, Artificial Sequence
  source: /note="Description of Artificial Sequence: Synthetic oligonucleotide"
uucaccagggca

SEQ ID NO: 3098 - RNA, 12 nt, Artificial Sequence
  source: /note="Description of Artificial Sequence: Synthetic oligonucleotide"
uuucaccagggc

SEQ ID NO: 3099 - RNA, 12 nt, Artificial Sequence
  source: /note="Description of Artificial Sequence: Synthetic oligonucleotide"
uuuucaccaggg

SEQ ID NO: 3100 - RNA, 12 nt, Artificial Sequence
  source: /note="Description of Artificial Sequence: Synthetic oligonucleotide"
auuuucaccagg

SEQ ID NO: 3101 - RNA, 12 nt, Artificial Sequence
  source: /note="Description of Artificial Sequence: Synthetic oligonucleotide"
cauuuucaccag

SEQ ID NO: 3102 - RNA, 12 nt, Artificial Sequence
  source: /note="Description of Artificial Sequence: Synthetic oligonucleotide"
gcauuuucacca

SEQ ID NO: 3103 - RNA, 12 nt, Artificial Sequence
  source: /note="Description of Artificial Sequence: Synthetic oligonucleotide"
agcauuuucacc

SEQ ID NO: 3104 - RNA, 12 nt, Artificial Sequence
  source: /note="Description of Artificial Sequence: Synthetic oligonucleotide"
aagcauuuucac

SEQ ID NO: 3105 - RNA, 12 nt, Artificial Sequence
  source: /note="Description of Artificial Sequence: Synthetic oligonucleotide"
uggugaaccaag

SEQ ID NO: 3106 - RNA, 12 nt, Artificial Sequence
  source: /note="Description of Artificial Sequence: Synthetic oligonucleotide"
cuggugaaccaa

SEQ ID NO: 3107 - RNA, 12 nt, Artificial Sequence
  source: /note="Description of Artificial Sequence: Synthetic oligonucleotide"
acuggugaacca

SEQ ID NO: 3108 - RNA, 12 nt, Artificial Sequence
  source: /note="Description of Artificial Sequence: Synthetic oligonucleotide"
cacuggugaacc

SEQ ID NO: 3109 - RNA, 12 nt, Artificial Sequence
  source: /note="Description of Artificial Sequence: Synthetic oligonucleotide"
ccacuggugaac

SEQ ID NO: 3110 - RNA, 12 nt, Artificial Sequence
  source: /note="Description of Artificial Sequence: Synthetic oligonucleotide"
uccacuggugaa

SEQ ID NO: 3111 - RNA, 12 nt, Artificial Sequence
  source: /note="Description of Artificial Sequence: Synthetic oligonucleotide"
auccacugguga

SEQ ID NO: 3112 - RNA, 12 nt, Artificial Sequence
  source: /note="Description of Artificial Sequence: Synthetic oligonucleotide"
aauccacuggug

SEQ ID NO: 3113 - RNA, 12 nt, Artificial Sequence
  source: /note="Description of Artificial Sequence: Synthetic oligonucleotide"
cagaauccacug

SEQ ID NO: 3114 - RNA, 12 nt, Artificial Sequence
  source: /note="Description of Artificial Sequence: Synthetic oligonucleotide"
acagaauccacu

SEQ ID NO: 3115 - RNA, 12 nt, Artificial Sequence
  source: /note="Description of Artificial Sequence: Synthetic oligonucleotide"
cacagaauccac

SEQ ID NO: 3116 - RNA, 12 nt, Artificial Sequence
  source: /note="Description of Artificial Sequence: Synthetic oligonucleotide"
acacagaaucca

SEQ ID NO: 3117 - RNA, 12 nt, Artificial Sequence
  source: /note="Description of Artificial Sequence: Synthetic oligonucleotide"
aacacagaaucc

SEQ ID NO: 3118 - RNA, 12 nt, Artificial Sequence
  source: /note="Description of Artificial Sequence: Synthetic oligonucleotide"
caacacagaauc

SEQ ID NO: 3119 - RNA, 12 nt, Artificial Sequence
  source: /note="Description of Artificial Sequence: Synthetic oligonucleotide"
acaacacagaau

SEQ ID NO: 3120 - RNA, 12 nt, Artificial Sequence
  source: /note="Description of Artificial Sequence: Synthetic oligonucleotide"
aacaacacagaa

SEQ ID NO: 3121 - RNA, 12 nt, Artificial Sequence
  source: /note="Description of Artificial Sequence: Synthetic oligonucleotide"
aaacaacacaga

SEQ ID NO: 3122 - RNA, 12 nt, Artificial Sequence
  source: /note="Description of Artificial Sequence: Synthetic oligonucleotide"
aaaacaacacag

SEQ ID NO: 3123 - RNA, 12 nt, Artificial Sequence
  source: /note="Description of Artificial Sequence: Synthetic oligonucleotide"
uaaaacaacaca

SEQ ID NO: 3124 - RNA, 12 nt, Artificial Sequence
  source: /note="Description of Artificial Sequence: Synthetic oligonucleotide"
auaaaacaacac

SEQ ID NO: 3125 - RNA, 12 nt, Artificial Sequence
  source: /note="Description of Artificial Sequence: Synthetic oligonucleotide"
cauaaaacaaca

SEQ ID NO: 3126 - RNA, 12 nt, Artificial Sequence
  source: /note="Description of Artificial Sequence: Synthetic oligonucleotide"
gcauaaaacaac

SEQ ID NO: 3127 - RNA, 12 nt, Artificial Sequence
  source: /note="Description of Artificial Sequence: Synthetic oligonucleotide"
ggcauaaaacaa

SEQ ID NO: 3128 - RNA, 12 nt, Artificial Sequence
  source: /note="Description of Artificial Sequence: Synthetic oligonucleotide"
uggcauaaaaca

SEQ ID NO: 3129 - RNA, 12 nt, Artificial Sequence
  source: /note="Description of Artificial Sequence: Synthetic oligonucleotide"
auggcauaaaac

SEQ ID NO: 3130 - RNA, 12 nt, Artificial Sequence
  source: /note="Description of Artificial Sequence: Synthetic oligonucleotide"
aauggcauaaaa

SEQ ID NO: 3131 - RNA, 12 nt, Artificial Sequence
  source: /note="Description of Artificial Sequence: Synthetic oligonucleotide"
uaauggcauaaa

SEQ ID NO: 3132 - RNA, 12 nt, Artificial Sequence
  source: /note="Description of Artificial Sequence: Synthetic oligonucleotide"
uguaauggcaua

SEQ ID NO: 3133 - RNA, 12 nt, Artificial Sequence
  source: /note="Description of Artificial Sequence: Synthetic oligonucleotide"
uuguaauggcau

SEQ ID NO: 3134 - RNA, 12 nt, Artificial Sequence
  source: /note="Description of Artificial Sequence: Synthetic oligonucleotide"
gaguuguaaugg

SEQ ID NO: 3135 - RNA, 12 nt, Artificial Sequence
  source: /note="Description of Artificial Sequence: Synthetic oligonucleotide"
agaguuguaaug

SEQ ID NO: 3136 - RNA, 12 nt, Artificial Sequence
  source: /note="Description of Artificial Sequence: Synthetic oligonucleotide"
gagaguuguaau

SEQ ID NO: 3137 - RNA, 12 nt, Artificial Sequence
  source: /note="Description of Artificial Sequence: Synthetic oligonucleotide"
ggagaguuguaa

SEQ ID NO: 3138 - RNA, 12 nt, Artificial Sequence
  source: /note="Description of Artificial Sequence: Synthetic oligonucleotide"
uggagaguugua

SEQ ID NO: 3139 - RNA, 12 nt, Artificial Sequence
  source: /note="Description of Artificial Sequence: Synthetic oligonucleotide"
guggagaguugu

SEQ ID NO: 3140 - RNA, 12 nt, Artificial Sequence
  source: /note="Description of Artificial Sequence: Synthetic oligonucleotide"
uguggagaguug

SEQ ID NO: 3141 - RNA, 12 nt, Artificial Sequence
  source: /note="Description of Artificial Sequence: Synthetic oligonucleotide"
uuguggagaguu

SEQ ID NO: 3142 - RNA, 12 nt, Artificial Sequence
  source: /note="Description of Artificial Sequence: Synthetic oligonucleotide"
guuguggagagu

SEQ ID NO: 3143 - RNA, 12 nt, Artificial Sequence
  source: /note="Description of Artificial Sequence: Synthetic oligonucleotide"
gguuguggagag

SEQ ID NO: 3144 - RNA, 12 nt, Artificial Sequence
  source: /note="Description of Artificial Sequence: Synthetic oligonucleotide"
agguuguggaga

SEQ ID NO: 3145 - RNA, 12 nt, Artificial Sequence
  source: /note="Description of Artificial Sequence: Synthetic oligonucleotide"
aagguuguggag

SEQ ID NO: 3146 - RNA, 12 nt, Artificial Sequence
  source: /note="Description of Artificial Sequence: Synthetic oligonucleotide"
aaagguugugga

SEQ ID NO: 3147 - RNA, 12 nt, Artificial Sequence
  source: /note="Description of Artificial Sequence: Synthetic oligonucleotide"
aaaagguugugg

SEQ ID NO: 3148 - RNA, 12 nt, Artificial Sequence
  source: /note="Description of Artificial Sequence: Synthetic oligonucleotide"
uaaaagguugug

SEQ ID NO: 3149 - RNA, 12 nt, Artificial Sequence
  source: /note="Description of Artificial Sequence: Synthetic oligonucleotide"
auaaaagguugu

SEQ ID NO: 3150 - RNA, 12 nt, Artificial Sequence
  source: /note="Description of Artificial Sequence: Synthetic oligonucleotide"
aauaaaagguug

SEQ ID NO: 3151 - RNA, 12 nt, Artificial Sequence
  source: /note="Description of Artificial Sequence: Synthetic oligonucleotide"
uaauaaaagguu

SEQ ID NO: 3152 - RNA, 12 nt, Artificial Sequence
  source: /note="Description of Artificial Sequence: Synthetic oligonucleotide"
uguaauaaaagg

SEQ ID NO: 3153 - RNA, 12 nt, Artificial Sequence
  source: /note="Description of Artificial Sequence: Synthetic oligonucleotide"
auguaauaaaag

SEQ ID NO: 3154 - RNA, 12 nt, Artificial Sequence
  source: /note="Description of Artificial Sequence: Synthetic oligonucleotide"
gauguaauaaaa

SEQ ID NO: 3155 - RNA, 12 nt, Artificial Sequence
  source: /note="Description of Artificial Sequence: Synthetic oligonucleotide"
ugauguaauaaa

SEQ ID NO: 3156 - RNA, 12 nt, Artificial Sequence
  source: /note="Description of Artificial Sequence: Synthetic oligonucleotide"
uugauguaauaa

SEQ ID NO: 3157 - RNA, 12 nt, Artificial Sequence
  source: /note="Description of Artificial Sequence: Synthetic oligonucleotide"
uucuugauguaa

SEQ ID NO: 3158 - RNA, 12 nt, Artificial Sequence
  source: /note="Description of Artificial Sequence: Synthetic oligonucleotide"
cuucuugaugua

SEQ ID NO: 3159 - RNA, 12 nt, Artificial Sequence
  source: /note="Description of Artificial Sequence: Synthetic oligonucleotide"
ccuucuugaugu

SEQ ID NO: 3160 - RNA, 12 nt, Artificial Sequence
  source: /note="Description of Artificial Sequence: Synthetic oligonucleotide"
uccuucuugaug

SEQ ID NO: 3161 - RNA, 12 nt, Artificial Sequence
  source: /note="Description of Artificial Sequence: Synthetic oligonucleotide"
cuccuucuugau

SEQ ID NO: 3162 - RNA, 12 nt, Artificial Sequence
  source: /note="Description of Artificial Sequence: Synthetic oligonucleotide"
gcuccuucuuga

SEQ ID NO: 3163 - RNA, 12 nt, Artificial Sequence
  source: /note="Description of Artificial Sequence: Synthetic oligonucleotide"
agcuccuucuug

SEQ ID NO: 3164 - RNA, 12 nt, Artificial Sequence
  source: /note="Description of Artificial Sequence: Synthetic oligonucleotide"
uagcuccuucuu

SEQ ID NO: 3165 - RNA, 12 nt, Artificial Sequence
  source: /note="Description of Artificial Sequence: Synthetic oligonucleotide"
uuagcuccuucu

SEQ ID NO: 3166 - RNA, 12 nt, Artificial Sequence
  source: /note="Description of Artificial Sequence: Synthetic oligonucleotide"
uuuagcuccuuc

SEQ ID NO: 3167 - RNA, 12 nt, Artificial Sequence
  source: /note="Description of Artificial Sequence: Synthetic oligonucleotide"
uuuuagcuccuu

SEQ ID NO: 3168 - RNA, 12 nt, Artificial Sequence
  source: /note="Description of Artificial Sequence: Synthetic oligonucleotide"
auuuuagcuccu

SEQ ID NO: 3169 - RNA, 12 nt, Artificial Sequence
  source: /note="Description of Artificial Sequence: Synthetic oligonucleotide"
ugccauuuuagc

SEQ ID NO: 3170 - RNA, 12 nt, Artificial Sequence
  source: /note="Description of Artificial Sequence: Synthetic oligonucleotide"
cugccauuuuag

SEQ ID NO: 3171 - RNA, 12 nt, Artificial Sequence
  source: /note="Description of Artificial Sequence: Synthetic oligonucleotide"
acugccauuuua

SEQ ID NO: 3172 - RNA, 12 nt, Artificial Sequence
  source: /note="Description of Artificial Sequence: Synthetic oligonucleotide"
cacugccauuuu

SEQ ID NO: 3173 - RNA, 12 nt, Artificial Sequence
  source: /note="Description of Artificial Sequence: Synthetic oligonucleotide"
gcacugccauuu

SEQ ID NO: 3174 - RNA, 12 nt, Artificial Sequence
  source: /note="Description of Artificial Sequence: Synthetic oligonucleotide"
cgcacugccauu

SEQ ID NO: 3175 - RNA, 12 nt, Artificial Sequence
  source: /note="Description of Artificial Sequence: Synthetic oligonucleotide"
acgcacugccau

SEQ ID NO: 3176 - RNA, 12 nt, Artificial Sequence
  source: /note="Description of Artificial Sequence: Synthetic oligonucleotide"
aacgcacugcca

SEQ ID NO: 3177 - RNA, 12 nt, Artificial Sequence
  source: /note="Description of Artificial Sequence: Synthetic oligonucleotide"
gcaaggcaacca

SEQ ID NO: 3178 - RNA, 12 nt, Artificial Sequence
  source: /note="Description of Artificial Sequence: Synthetic oligonucleotide"
agcaaggcaacc

SEQ ID NO: 3179 - RNA, 12 nt, Artificial Sequence
  source: /note="Description of Artificial Sequence: Synthetic oligonucleotide"
gagcaaggcaac

SEQ ID NO: 3180 - RNA, 12 nt, Artificial Sequence
  source: /note="Description of Artificial Sequence: Synthetic oligonucleotide"
ugagcaaggcaa

SEQ ID NO: 3181 - RNA, 12 nt, Artificial Sequence
  source: /note="Description of Artificial Sequence: Synthetic oligonucleotide"
uugagcaaggca

SEQ ID NO: 3182 - RNA, 12 nt, Artificial Sequence
  source: /note="Description of Artificial Sequence: Synthetic oligonucleotide"
guugagcaaggc

SEQ ID NO: 3183 - RNA, 12 nt, Artificial Sequence
  source: /note="Description of Artificial Sequence: Synthetic oligonucleotide"
uguugagcaagg

SEQ ID NO: 3184 - RNA, 12 nt, Artificial Sequence
  source: /note="Description of Artificial Sequence: Synthetic oligonucleotide"
uuguugagcaag

SEQ ID NO: 3185 - RNA, 12 nt, Artificial Sequence
  source: /note="Description of Artificial Sequence: Synthetic oligonucleotide"
uuuguugagcaa

SEQ ID NO: 3186 - RNA, 12 nt, Artificial Sequence
  source: /note="Description of Artificial Sequence: Synthetic oligonucleotide"
uuuuguugagca

SEQ ID NO: 3187 - RNA, 12 nt, Artificial Sequence
  source: /note="Description of Artificial Sequence: Synthetic oligonucleotide"
guuuuguugagc

SEQ ID NO: 3188 - RNA, 12 nt, Artificial Sequence
  source: /note="Description of Artificial Sequence: Synthetic oligonucleotide"
uguuuuguugag

SEQ ID NO: 3189 - RNA, 12 nt, Artificial Sequence
  source: /note="Description of Artificial Sequence: Synthetic oligonucleotide"
uuguuuuguuga

SEQ ID NO: 3190 - RNA, 12 nt, Artificial Sequence
  source: /note="Description of Artificial Sequence: Synthetic oligonucleotide"
ggguccaccacu

SEQ ID NO: 3191 - RNA, 12 nt, Artificial Sequence
  source: /note="Description of Artificial Sequence: Synthetic oligonucleotide"
gggguccaccac

SEQ ID NO: 3192 - RNA, 12 nt, Artificial Sequence
  source: /note="Description of Artificial Sequence: Synthetic oligonucleotide"
ugggguccacca

SEQ ID NO: 3193 - RNA, 12 nt, Artificial Sequence
  source: /note="Description of Artificial Sequence: Synthetic oligonucleotide"
uugggguccacc

SEQ ID NO: 3194 - RNA, 12 nt, Artificial Sequence
  source: /note="Description of Artificial Sequence: Synthetic oligonucleotide"
cuugggguccac

SEQ ID NO: 3195 - RNA, 12 nt, Artificial Sequence
  source: /note="Description of Artificial Sequence: Synthetic oligonucleotide"
gcuuggggucca

SEQ ID NO: 3196 - RNA, 12 nt, Artificial Sequence
  source: /note="Description of Artificial Sequence: Synthetic oligonucleotide"
agcuuggggucc

SEQ ID NO: 3197 - RNA, 12 nt, Artificial Sequence
  source: /note="Description of Artificial Sequence: Synthetic oligonucleotide"
aagcuugggguc

SEQ ID NO: 3198 - RNA, 12 nt, Artificial Sequence
  source: /note="Description of Artificial Sequence: Synthetic oligonucleotide"
aaagcuuggggu

SEQ ID NO: 3199 - RNA, 12 nt, Artificial Sequence
  source: /note="Description of Artificial Sequence: Synthetic oligonucleotide"
uaaagcuugggg

SEQ ID NO: 3200 - RNA, 12 nt, Artificial Sequence
  source: /note="Description of Artificial Sequence: Synthetic oligonucleotide"
cuaaagcuuggg

SEQ ID NO: 3201 - RNA, 12 nt, Artificial Sequence
  source: /note="Description of Artificial Sequence: Synthetic oligonucleotide"
acuaaagcuugg

SEQ ID NO: 3202 - RNA, 12 nt, Artificial Sequence
  source: /note="Description of Artificial Sequence: Synthetic oligonucleotide"
uacuaaagcuug

SEQ ID NO: 3203 - RNA, 12 nt, Artificial Sequence
  source: /note="Description of Artificial Sequence: Synthetic oligonucleotide"
uuacuaaagcuu

SEQ ID NO: 3204 - RNA, 12 nt, Artificial Sequence
  source: /note="Description of Artificial Sequence: Synthetic oligonucleotide"
uuuacuaaagcu

SEQ ID NO: 3205 - RNA, 12 nt, Artificial Sequence
  source: /note="Description of Artificial Sequence: Synthetic oligonucleotide"
auuuacuaaagc

SEQ ID NO: 3206 - RNA, 12 nt, Artificial Sequence
  source: /note="Description of Artificial Sequence: Synthetic oligonucleotide"
uauuuacuaaag

SEQ ID NO: 3207 - RNA, 12 nt, Artificial Sequence
  source: /note="Description of Artificial Sequence: Synthetic oligonucleotide"
auauuuacuaaa

SEQ ID NO: 3208 - RNA, 12 nt, Artificial Sequence
  source: /note="Description of Artificial Sequence: Synthetic oligonucleotide"
uauauuuacuaa

SEQ ID NO: 3209 - RNA, 12 nt, Artificial Sequence
  source: /note="Description of Artificial Sequence: Synthetic oligonucleotide"
uuauauuuacua

SEQ ID NO: 3210 - RNA, 12 nt, Artificial Sequence
  source: /note="Description of Artificial Sequence: Synthetic oligonucleotide"
cucauuauauuu

SEQ ID NO: 3211 - RNA, 12 nt, Artificial Sequence
  source: /note="Description of Artificial Sequence: Synthetic oligonucleotide"
ccucauuauauu

SEQ ID NO: 3212 - RNA, 12 nt, Artificial Sequence
  source: /note="Description of Artificial Sequence: Synthetic oligonucleotide"
uccucauuauau

SEQ ID NO: 3213 - RNA, 12 nt, Artificial Sequence
  source: /note="Description of Artificial Sequence: Synthetic oligonucleotide"
guccucauuaua

SEQ ID NO: 3214 - RNA, 12 nt, Artificial Sequence
  source: /note="Description of Artificial Sequence: Synthetic oligonucleotide"
gguccucauuau

SEQ ID NO: 3215 - RNA, 12 nt, Artificial Sequence
  source: /note="Description of Artificial Sequence: Synthetic oligonucleotide"
agguccucauua

SEQ ID NO: 3216 - RNA, 12 nt, Artificial Sequence
  source: /note="Description of Artificial Sequence: Synthetic oligonucleotide"
uagguccucauu

SEQ ID NO: 3217 - RNA, 12 nt, Artificial Sequence
  source: /note="Description of Artificial Sequence: Synthetic oligonucleotide"
auagguccucau

SEQ ID NO: 3218 - RNA, 12 nt, Artificial Sequence
  source: /note="Description of Artificial Sequence: Synthetic oligonucleotide"
uauagguccuca

SEQ ID NO: 3219 - RNA, 12 nt, Artificial Sequence
  source: /note="Description of Artificial Sequence: Synthetic oligonucleotide"
cacucugcuugu

SEQ ID NO: 3220 - RNA, 12 nt, Artificial Sequence
  source: /note="Description of Artificial Sequence: Synthetic oligonucleotide"
gcacucugcuug

SEQ ID NO: 3221 - RNA, 12 nt, Artificial Sequence
  source: /note="Description of Artificial Sequence: Synthetic oligonucleotide"
agcacucugcuu

SEQ ID NO: 3222 - RNA, 12 nt, Artificial Sequence
  source: /note="Description of Artificial Sequence: Synthetic oligonucleotide"
cagcacucugcu

SEQ ID NO: 3223 - RNA, 12 nt, Artificial Sequence
  source: /note="Description of Artificial Sequence: Synthetic oligonucleotide"
ucagcacucugc

SEQ ID NO: 3224 - RNA, 12 nt, Artificial Sequence
  source: /note="Description of Artificial Sequence: Synthetic oligonucleotide"
uucagcacucug

SEQ ID NO: 3225 - RNA, 12 nt, Artificial Sequence
  source: /note="Description of Artificial Sequence: Synthetic oligonucleotide"
cuucagcacucu

SEQ ID NO: 3226 - RNA, 12 nt, Artificial Sequence
  source: /note="Description of Artificial Sequence: Synthetic oligonucleotide"
ccuucagcacuc

SEQ ID NO: 3227 - RNA, 12 nt, Artificial Sequence
  source: /note="Description of Artificial Sequence: Synthetic oligonucleotide"
accuucagcacu

SEQ ID NO: 3228 - RNA, 12 nt, Artificial Sequence
  source: /note="Description of Artificial Sequence: Synthetic oligonucleotide"
caccuucagcac

SEQ ID NO: 3229 - RNA, 12 nt, Artificial Sequence
  source: /note="Description of Artificial Sequence: Synthetic oligonucleotide"
gcaccuucagca

SEQ ID NO: 3230 - RNA, 12 nt, Artificial Sequence
  source: /note="Description of Artificial Sequence: Synthetic oligonucleotide"
agcaccuucagc

SEQ ID NO: 3231 - RNA, 12 nt, Artificial Sequence
  source: /note="Description of Artificial Sequence: Synthetic oligonucleotide"
uagcaccuucag

SEQ ID NO: 3232 - RNA, 12 nt, Artificial Sequence
  source: /note="Description of Artificial Sequence: Synthetic oligonucleotide"
uacuagagcaga

SEQ ID NO: 3233 - RNA, 12 nt, Artificial Sequence
  source: /note="Description of Artificial Sequence: Synthetic oligonucleotide"
uuacuagagcag

SEQ ID NO: 3234 - RNA, 12 nt, Artificial Sequence
  source: /note="Description of Artificial Sequence: Synthetic oligonucleotide"
auuacuagagca

SEQ ID NO: 3235 - RNA, 12 nt, Artificial Sequence
  source: /note="Description of Artificial Sequence: Synthetic oligonucleotide"
uauuacuagagc

SEQ ID NO: 3236 - RNA, 12 nt, Artificial Sequence
  source: /note="Description of Artificial Sequence: Synthetic oligonucleotide"
uuauuacuagag

SEQ ID NO: 3237 - RNA, 12 nt, Artificial Sequence
  source: /note="Description of Artificial Sequence: Synthetic oligonucleotide"
cuuauuacuaga

SEQ ID NO: 3238 - RNA, 12 nt, Artificial Sequence
  source: /note="Description of Artificial Sequence: Synthetic oligonucleotide"
gcuuauuacuag

SEQ ID NO: 3239 - RNA, 12 nt, Artificial Sequence
  source: /note="Description of Artificial Sequence: Synthetic oligonucleotide"
cagcuucuacaa

SEQ ID NO: 3240 - RNA, 12 nt, Artificial Sequence
  source: /note="Description of Artificial Sequence: Synthetic oligonucleotide"
ccagcuucuaca

SEQ ID NO: 3241 - RNA, 12 nt, Artificial Sequence
  source: /note="Description of Artificial Sequence: Synthetic oligonucleotide"
accagcuucuac

SEQ ID NO: 3242 - RNA, 12 nt, Artificial Sequence
  source: /note="Description of Artificial Sequence: Synthetic oligonucleotide"
caccagcuucua

SEQ ID NO: 3243 - RNA, 12 nt, Artificial Sequence
  source: /note="Description of Artificial Sequence: Synthetic oligonucleotide"
ccaccagcuucu

SEQ ID NO: 3244 - RNA, 12 nt, Artificial Sequence
  source: /note="Description of Artificial Sequence: Synthetic oligonucleotide"
uccaccagcuuc

SEQ ID NO: 3245 - RNA, 12 nt, Artificial Sequence
  source: /note="Description of Artificial Sequence: Synthetic oligonucleotide"
uuccaccagcuu

SEQ ID NO: 3246 - RNA, 12 nt, Artificial Sequence
  source: /note="Description of Artificial Sequence: Synthetic oligonucleotide"
gcauuccaccag

SEQ ID NO: 3247 - RNA, 12 nt, Artificial Sequence
  source: /note="Description of Artificial Sequence: Synthetic oligonucleotide"
ugcauuccacca

SEQ ID NO: 3248 - RNA, 12 nt, Artificial Sequence
  source: /note="Description of Artificial Sequence: Synthetic oligonucleotide"
uugcauuccacc

SEQ ID NO: 3249 - RNA, 12 nt, Artificial Sequence
  source: /note="Description of Artificial Sequence: Synthetic oligonucleotide"
cuugcauuccac

SEQ ID NO: 3250 - RNA, 12 nt, Artificial Sequence
  source: /note="Description of Artificial Sequence: Synthetic oligonucleotide"
gcuugcauucca

SEQ ID NO: 3251 - RNA, 12 nt, Artificial Sequence
  source: /note="Description of Artificial Sequence: Synthetic oligonucleotide"
agcuugcauucc

SEQ ID NO: 3252 - RNA, 12 nt, Artificial Sequence
  source: /note="Description of Artificial Sequence: Synthetic oligonucleotide"
aagcuugcauuc

SEQ ID NO: 3253 - RNA, 12 nt, Artificial Sequence
  source: /note="Description of Artificial Sequence: Synthetic oligonucleotide"
ugucaggugaag

SEQ ID NO: 3254 - RNA, 12 nt, Artificial Sequence
  source: /note="Description of Artificial Sequence: Synthetic oligonucleotide"
cugucaggugaa

SEQ ID NO: 3255 - RNA, 12 nt, Artificial Sequence
  source: /note="Description of Artificial Sequence: Synthetic oligonucleotide"
ucugucagguga

SEQ ID NO: 3256 - RNA, 12 nt, Artificial Sequence
  source: /note="Description of Artificial Sequence: Synthetic oligonucleotide"
aucugucaggug

SEQ ID NO: 3257 - RNA, 12 nt, Artificial Sequence
  source: /note="Description of Artificial Sequence: Synthetic oligonucleotide"
ggaucugucagg

SEQ ID NO: 3258 - RNA, 12 nt, Artificial Sequence
  source: /note="Description of Artificial Sequence: Synthetic oligonucleotide"
uggaucugucag

SEQ ID NO: 3259 - RNA, 12 nt, Artificial Sequence
  source: /note="Description of Artificial Sequence: Synthetic oligonucleotide"
uuggaucuguca

SEQ ID NO: 3260 - RNA, 12 nt, Artificial Sequence
  source: /note="Description of Artificial Sequence: Synthetic oligonucleotide"
ugacuuggaucu

SEQ ID NO: 3261 - RNA, 12 nt, Artificial Sequence
  source: /note="Description of Artificial Sequence: Synthetic oligonucleotide"
uugacuuggauc

SEQ ID NO: 3262 - RNA, 12 nt, Artificial Sequence
  source: /note="Description of Artificial Sequence: Synthetic oligonucleotide"
cguugacuugga

SEQ ID NO: 3263 - RNA, 12 nt, Artificial Sequence
  source: /note="Description of Artificial Sequence: Synthetic oligonucleotide"
acguugacuugg

SEQ ID NO: 3264 - RNA, 12 nt, Artificial Sequence
  source: /note="Description of Artificial Sequence: Synthetic oligonucleotide"
gacguugacuug

SEQ ID NO: 3265 - RNA, 12 nt, Artificial Sequence
  source: /note="Description of Artificial Sequence: Synthetic oligonucleotide"
agacguugacuu

SEQ ID NO: 3266 - RNA, 12 nt, Artificial Sequence
  source: /note="Description of Artificial Sequence: Synthetic oligonucleotide"
aagacguugacu

SEQ ID NO: 3267 - RNA, 12 nt, Artificial Sequence
  source: /note="Description of Artificial Sequence: Synthetic oligonucleotide"
guucugaacaag

SEQ ID NO: 3268 - RNA, 12 nt, Artificial Sequence
  source: /note="Description of Artificial Sequence: Synthetic oligonucleotide"
aguucugaacaa

SEQ ID NO: 3269 - RNA, 12 nt, Artificial Sequence
  source: /note="Description of Artificial Sequence: Synthetic oligonucleotide"
caguucugaaca

SEQ ID NO: 3270 - RNA, 12 nt, Artificial Sequence
  source: /note="Description of Artificial Sequence: Synthetic oligonucleotide"
acaguucugaac

SEQ ID NO: 3271 - RNA, 12 nt, Artificial Sequence
  source: /note="Description of Artificial Sequence: Synthetic oligonucleotide"
gacaguucugaa

SEQ ID NO: 3272 - RNA, 12 nt, Artificial Sequence
  source: /note="Description of Artificial Sequence: Synthetic oligonucleotide"
agacaguucuga

SEQ ID NO: 3273 - RNA, 12 nt, Artificial Sequence
  source: /note="Description of Artificial Sequence: Synthetic oligonucleotide"
aagacaguucug

SEQ ID NO: 3274 - RNA, 12 nt, Artificial Sequence
  source: /note="Description of Artificial Sequence: Synthetic oligonucleotide"
uccaaagacagu

SEQ ID NO: 3275 - RNA, 12 nt, Artificial Sequence
  source: /note="Description of Artificial Sequence: Synthetic oligonucleotide"
guccaaagacag

SEQ ID NO: 3276 - RNA, 12 nt, Artificial Sequence
  source: /note="Description of Artificial Sequence: Synthetic oligonucleotide"
aguccaaagaca

SEQ ID NO: 3277 - RNA, 12 nt, Artificial Sequence
  source: /note="Description of Artificial Sequence: Synthetic oligonucleotide"
gaguccaaagac

SEQ ID NO: 3278 - RNA, 12 nt, Artificial Sequence
  source: /note="Description of Artificial Sequence: Synthetic oligonucleotide"
agaguccaaaga

SEQ ID NO: 3279 - RNA, 12 nt, Artificial Sequence
  source: /note="Description of Artificial Sequence: Synthetic oligonucleotide"
gagaguccaaag

SEQ ID NO: 3280 - RNA, 12 nt, Artificial Sequence
  source: /note="Description of Artificial Sequence: Synthetic oligonucleotide"
ugagaguccaaa

SEQ ID NO: 3281 - RNA, 12 nt, Artificial Sequence
  source: /note="Description of Artificial Sequence: Synthetic oligonucleotide"
cugagaguccaa

SEQ ID NO: 3282 - RNA, 12 nt, Artificial Sequence
  source: /note="Description of Artificial Sequence: Synthetic oligonucleotide"
ccugagagucca

SEQ ID NO: 3283 - RNA, 12 nt, Artificial Sequence
  source: /note="Description of Artificial Sequence: Synthetic oligonucleotide"
uccugagagucc

SEQ ID NO: 3284 - RNA, 12 nt, Artificial Sequence
  source: /note="Description of Artificial Sequence: Synthetic oligonucleotide"
uuccugagaguc

SEQ ID NO: 3285 - RNA, 12 nt, Artificial Sequence
  source: /note="Description of Artificial Sequence: Synthetic oligonucleotide"
auuccugagagu

SEQ ID NO: 3286 - RNA, 12 nt, Artificial Sequence
  source: /note="Description of Artificial Sequence: Synthetic oligonucleotide"
gauuccugagag

SEQ ID NO: 3287 - RNA, 12 nt, Artificial Sequence
  source: /note="Description of Artificial Sequence: Synthetic oligonucleotide"
agauuccugaga

SEQ ID NO: 3288 - RNA, 12 nt, Artificial Sequence
  source: /note="Description of Artificial Sequence: Synthetic oligonucleotide"
aagauuccugag

SEQ ID NO: 3289 - RNA, 12 nt, Artificial Sequence
  source: /note="Description of Artificial Sequence: Synthetic oligonucleotide"
aaagauuccuga

SEQ ID NO: 3290 - RNA, 12 nt, Artificial Sequence
  source: /note="Description of Artificial Sequence: Synthetic oligonucleotide"
aucugaaagauu

SEQ ID NO: 3291 - RNA, 12 nt, Artificial Sequence
  source: /note="Description of Artificial Sequence: Synthetic oligonucleotide"
agcaucugaaag

SEQ ID NO: 3292 - RNA, 12 nt, Artificial Sequence
  source: /note="Description of Artificial Sequence: Synthetic oligonucleotide"
cagcaucugaaa

SEQ ID NO: 3293 - RNA, 12 nt, Artificial Sequence
  source: /note="Description of Artificial Sequence: Synthetic oligonucleotide"
gcagcaucugaa

SEQ ID NO: 3294 - RNA, 12 nt, Artificial Sequence
  source: /note="Description of Artificial Sequence: Synthetic oligonucleotide"
ugcagcaucuga

SEQ ID NO: 3295 - RNA, 12 nt, Artificial Sequence
  source: /note="Description of Artificial Sequence: Synthetic oligonucleotide"
uugcagcaucug

SEQ ID NO: 3296 - RNA, 12 nt, Artificial Sequence
  source: /note="Description of Artificial Sequence: Synthetic oligonucleotide"
guugcagcaucu

SEQ ID NO: 3297 - RNA, 12 nt, Artificial Sequence
  source: /note="Description of Artificial Sequence: Synthetic oligonucleotide"
aguugcagcauc

SEQ ID NO: 3298 - RNA, 12 nt, Artificial Sequence
  source: /note="Description of Artificial Sequence: Synthetic oligonucleotide"
uaguugcagcau

SEQ ID NO: 3299 - RNA, 12 nt, Artificial Sequence
  source: /note="Description of Artificial Sequence: Synthetic oligonucleotide"
uuaguugcagca

SEQ ID NO: 3300 - RNA, 12 nt, Artificial Sequence
  source: /note="Description of Artificial Sequence: Synthetic oligonucleotide"
uuuaguugcagc

SEQ ID NO: 3301 - RNA, 12 nt, Artificial Sequence
  source: /note="Description of Artificial Sequence: Synthetic oligonucleotide"
gucccaaggaga

SEQ ID NO: 3302 - RNA, 12 nt, Artificial Sequence
  source: /note="Description of Artificial Sequence: Synthetic oligonucleotide"
agucccaaggag

SEQ ID NO: 3303 - RNA, 12 nt, Artificial Sequence
  source: /note="Description of Artificial Sequence: Synthetic oligonucleotide"
gagucccaagga

SEQ ID NO: 3304 - RNA, 12 nt, Artificial Sequence
  source: /note="Description of Artificial Sequence: Synthetic oligonucleotide"
agagucccaagg

SEQ ID NO: 3305 - RNA, 12 nt, Artificial Sequence
  source: /note="Description of Artificial Sequence: Synthetic oligonucleotide"
aagagucccaag

SEQ ID NO: 3306 - RNA, 12 nt, Artificial Sequence
  source: /note="Description of Artificial Sequence: Synthetic oligonucleotide"
acaagaguccca

SEQ ID NO: 3307 - RNA, 12 nt, Artificial Sequence
  source: /note="Description of Artificial Sequence: Synthetic oligonucleotide"
aacaagaguccc

SEQ ID NO: 3308 - RNA, 12 nt, Artificial Sequence
  source: /note="Description of Artificial Sequence: Synthetic oligonucleotide"
aagcugaacaag

SEQ ID NO: 3309 - RNA, 12 nt, Artificial Sequence
  source: /note="Description of Artificial Sequence: Synthetic oligonucleotide"
cccagaagcuga

SEQ ID NO: 3310 - RNA, 12 nt, Artificial Sequence
  source: /note="Description of Artificial Sequence: Synthetic oligonucleotide"
acccagaagcug

SEQ ID NO: 3311 - RNA, 12 nt, Artificial Sequence
  source: /note="Description of Artificial Sequence: Synthetic oligonucleotide"
aacccagaagcu

SEQ ID NO: 3312 - RNA, 12 nt, Artificial Sequence
  source: /note="Description of Artificial Sequence: Synthetic oligonucleotide"
gaacccagaagc

SEQ ID NO: 3313 - RNA, 12 nt, Artificial Sequence
  source: /note="Description of Artificial Sequence: Synthetic oligonucleotide"
ugaacccagaag

SEQ ID NO: 3314 - RNA, 12 nt, Artificial Sequence
  source: /note="Description of Artificial Sequence: Synthetic oligonucleotide"
cugaacccagaa

SEQ ID NO: 3315 - RNA, 12 nt, Artificial Sequence
  source: /note="Description of Artificial Sequence: Synthetic oligonucleotide"
ucugaacccaga

SEQ ID NO: 3316 - RNA, 12 nt, Artificial Sequence
  source: /note="Description of Artificial Sequence: Synthetic oligonucleotide"
aucugaacccag

SEQ ID NO: 3317 - RNA, 12 nt, Artificial Sequence
  source: /note="Description of Artificial Sequence: Synthetic oligonucleotide"
caucugaaccca

SEQ ID NO: 3318 - RNA, 12 nt, Artificial Sequence
  source: /note="Description of Artificial Sequence: Synthetic oligonucleotide"
ucaucugaaccc

SEQ ID NO: 3319 - RNA, 12 nt, Artificial Sequence
  source: /note="Description of Artificial Sequence: Synthetic oligonucleotide"
aucaucugaacc

SEQ ID NO: 3320 - RNA, 12 nt, Artificial Sequence
  source: /note="Description of Artificial Sequence: Synthetic oligonucleotide"
uaucaucugaac

SEQ ID NO: 3321 - RNA, 12 nt, Artificial Sequence
  source: /note="Description of Artificial Sequence: Synthetic oligonucleotide"
auaucaucugaa

SEQ ID NO: 3322 - RNA, 12 nt, Artificial Sequence
  source: /note="Description of Artificial Sequence: Synthetic oligonucleotide"
uauaucaucuga

SEQ ID NO: 3323 - RNA, 12 nt, Artificial Sequence
  source: /note="Description of Artificial Sequence: Synthetic oligonucleotide"
uuauaucaucug

SEQ ID NO: 3324 - RNA, 12 nt, Artificial Sequence
  source: /note="Description of Artificial Sequence: Synthetic oligonucleotide"
acauuuauauca

SEQ ID NO: 3325 - RNA, 12 nt, Artificial Sequence
  source: /note="Description of Artificial Sequence: Synthetic oligonucleotide"
cacauuuauauc

SEQ ID NO: 3326 - RNA, 12 nt, Artificial Sequence
  source: /note="Description of Artificial Sequence: Synthetic oligonucleotide"
ccacauuuauau

SEQ ID NO: 3327 - RNA, 12 nt, Artificial Sequence
  source: /note="Description of Artificial Sequence: Synthetic oligonucleotide"
accacauuuaua

SEQ ID NO: 3328 - RNA, 12 nt, Artificial Sequence
  source: /note="Description of Artificial Sequence: Synthetic oligonucleotide"
gaccacauuuau

SEQ ID NO: 3329 - RNA, 12 nt, Artificial Sequence
  source: /note="Description of Artificial Sequence: Synthetic oligonucleotide"
ugaccacauuua

SEQ ID NO: 3330 - RNA, 12 nt, Artificial Sequence
  source: /note="Description of Artificial Sequence: Synthetic oligonucleotide"
gugaccacauuu

SEQ ID NO: 3331 - RNA, 12 nt, Artificial Sequence
  source: /note="Description of Artificial Sequence: Synthetic oligonucleotide"
ggugaccacauu

SEQ ID NO: 3332 - RNA, 12 nt, Artificial Sequence
  source: /note="Description of Artificial Sequence: Synthetic oligonucleotide"
cugcacagguga

SEQ ID NO: 3333 - RNA, 12 nt, Artificial Sequence
  source: /note="Description of Artificial Sequence: Synthetic oligonucleotide"
gcugcacaggug

SEQ ID NO: 3334 - RNA, 12 nt, Artificial Sequence
  source: /note="Description of Artificial Sequence: Synthetic oligonucleotide"
agcugcacaggu

SEQ ID NO: 3335 - RNA, 12 nt, Artificial Sequence
  source: /note="Description of Artificial Sequence: Synthetic oligonucleotide"
cagcugcacagg

SEQ ID NO: 3336 - RNA, 12 nt, Artificial Sequence
  source: /note="Description of Artificial Sequence: Synthetic oligonucleotide"
ccagcugcacag

SEQ ID NO: 3337 - RNA, 12 nt, Artificial Sequence
  source: /note="Description of Artificial Sequence: Synthetic oligonucleotide"
uccagcugcaca

SEQ ID NO: 3338 - RNA, 12 nt, Artificial Sequence
  source: /note="Description of Artificial Sequence: Synthetic oligonucleotide"
uuccagcugcac

SEQ ID NO: 3339 - RNA, 12 nt, Artificial Sequence
  source: /note="Description of Artificial Sequence: Synthetic oligonucleotide"
auuccagcugca

SEQ ID NO: 3340 - RNA, 12 nt, Artificial Sequence
  source: /note="Description of Artificial Sequence: Synthetic oligonucleotide"
aauuccagcugc

SEQ ID NO: 3341 - RNA, 12 nt, Artificial Sequence
  source: /note="Description of Artificial Sequence: Synthetic oligonucleotide"
gaauuccagcug

SEQ ID NO: 3342 - RNA, 12 nt, Artificial Sequence
  source: /note="Description of Artificial Sequence: Synthetic oligonucleotide"
agaauuccagcu

SEQ ID NO: 3343 - RNA, 12 nt, Artificial Sequence
  source: /note="Description of Artificial Sequence: Synthetic oligonucleotide"
aagaauuccagc

SEQ ID NO: 3344 - RNA, 12 nt, Artificial Sequence
  source: /note="Description of Artificial Sequence: Synthetic oligonucleotide"
aaagaauuccag

SEQ ID NO: 3345 - RNA, 12 nt, Artificial Sequence
  source: /note="Description of Artificial Sequence: Synthetic oligonucleotide"
gaaagaauucca

SEQ ID NO: 3346 - RNA, 12 nt, Artificial Sequence
  source: /note="Description of Artificial Sequence: Synthetic oligonucleotide"
agaaagaauucc

SEQ ID NO: 3347 - RNA, 12 nt, Artificial Sequence
  source: /note="Description of Artificial Sequence: Synthetic oligonucleotide"
uagaaagaauuc

SEQ ID NO: 3348 - RNA, 12 nt, Artificial Sequence
  source: /note="Description of Artificial Sequence: Synthetic oligonucleotide"
ugagguuagaaa

SEQ ID NO: 3349 - RNA, 12 nt, Artificial Sequence
  source: /note="Description of Artificial Sequence: Synthetic oligonucleotide"
gugagguuagaa

SEQ ID NO: 3350 - RNA, 12 nt, Artificial Sequence
  source: /note="Description of Artificial Sequence: Synthetic oligonucleotide"
agugagguuaga

SEQ ID NO: 3351 - RNA, 12 nt, Artificial Sequence
  source: /note="Description of Artificial Sequence: Synthetic oligonucleotide"
aagugagguuag

SEQ ID NO: 3352 - RNA, 12 nt, Artificial Sequence
  source: /note="Description of Artificial Sequence: Synthetic oligonucleotide"
caagugagguua

SEQ ID NO: 3353 - RNA, 12 nt, Artificial Sequence
  source: /note="Description of Artificial Sequence: Synthetic oligonucleotide"
gcaagugagguu

SEQ ID NO: 3354 - RNA, 12 nt, Artificial Sequence
  source: /note="Description of Artificial Sequence: Synthetic oligonucleotide"
ugcaagugaggu

SEQ ID NO: 3355 - RNA, 12 nt, Artificial Sequence
  source: /note="Description of Artificial Sequence: Synthetic oligonucleotide"
uugcaagugagg

SEQ ID NO: 3356 - RNA, 12 nt, Artificial Sequence
  source: /note="Description of Artificial Sequence: Synthetic oligonucleotide"
auugcaagugag

SEQ ID NO: 3357 - RNA, 12 nt, Artificial Sequence
  source: /note="Description of Artificial Sequence: Synthetic oligonucleotide"
uauugcaaguga

SEQ ID NO: 3358 - RNA, 12 nt, Artificial Sequence
  source: /note="Description of Artificial Sequence: Synthetic oligonucleotide"
uuauugcaagug

SEQ ID NO: 3359 - RNA, 12 nt, Artificial Sequence
  source: /note="Description of Artificial Sequence: Synthetic oligonucleotide"
auuauugcaagu

SEQ ID NO: 3360 - RNA, 12 nt, Artificial Sequence
  source: /note="Description of Artificial Sequence: Synthetic oligonucleotide"
aauuauugcaag

SEQ ID NO: 3361 - RNA, 12 nt, Artificial Sequence
  source: /note="Description of Artificial Sequence: Synthetic oligonucleotide"
uaauuauugcaa

SEQ ID NO: 3362 - RNA, 12 nt, Artificial Sequence
  source: /note="Description of Artificial Sequence: Synthetic oligonucleotide"
auaauuauugca

SEQ ID NO: 3363 - RNA, 12 nt, Artificial Sequence
  source: /note="Description of Artificial Sequence: Synthetic oligonucleotide"
uauaauuauugc

SEQ ID NO: 3364 - RNA, 12 nt, Artificial Sequence
  source: /note="Description of Artificial Sequence: Synthetic oligonucleotide"
uuauaauuauug

SEQ ID NO: 3365 - RNA, 12 nt, Artificial Sequence
  source: /note="Description of Artificial Sequence: Synthetic oligonucleotide"
ccacuuggcaga

SEQ ID NO: 3366 - RNA, 12 nt, Artificial Sequence
  source: /note="Description of Artificial Sequence: Synthetic oligonucleotide"
cccacuuggcag

SEQ ID NO: 3367 - RNA, 12 nt, Artificial Sequence
  source: /note="Description of Artificial Sequence: Synthetic oligonucleotide"
acccacuuggca

SEQ ID NO: 3368 - RNA, 12 nt, Artificial Sequence
  source: /note="Description of Artificial Sequence: Synthetic oligonucleotide"
cacccacuuggc

SEQ ID NO: 3369 - RNA, 12 nt, Artificial Sequence
  source: /note="Description of Artificial Sequence: Synthetic oligonucleotide"
ccacccacuugg

SEQ ID NO: 3370 - RNA, 12 nt, Artificial Sequence
  source: /note="Description of Artificial Sequence: Synthetic oligonucleotide"
accacccacuug

SEQ ID NO: 3371 - RNA, 12 nt, Artificial Sequence
  source: /note="Description of Artificial Sequence: Synthetic oligonucleotide"
uaccacccacuu

SEQ ID NO: 3372 - RNA, 12 nt, Artificial Sequence
  source: /note="Description of Artificial Sequence: Synthetic oligonucleotide"
aagagccucuau

SEQ ID NO: 3373 - RNA, 12 nt, Artificial Sequence
  source: /note="Description of Artificial Sequence: Synthetic oligonucleotide"
cccugucaccag

SEQ ID NO: 3374 - RNA, 12 nt, Artificial Sequence
  source: /note="Description of Artificial Sequence: Synthetic oligonucleotide"
ucccugucacca

SEQ ID NO: 3375 - RNA, 12 nt, Artificial Sequence
  source: /note="Description of Artificial Sequence: Synthetic oligonucleotide"
uucccugucacc

SEQ ID NO: 3376 - RNA, 12 nt, Artificial Sequence
  source: /note="Description of Artificial Sequence: Synthetic oligonucleotide"
ugaugucuuccc

SEQ ID NO: 3377 - RNA, 12 nt, Artificial Sequence
  source: /note="Description of Artificial Sequence: Synthetic oligonucleotide"
gugaugucuucc

SEQ ID NO: 3378 - RNA, 12 nt, Artificial Sequence
  source: /note="Description of Artificial Sequence: Synthetic oligonucleotide"
agugaugucuuc

SEQ ID NO: 3379 - RNA, 12 nt, Artificial Sequence
  source: /note="Description of Artificial Sequence: Synthetic oligonucleotide"
cagugaugucuu

SEQ ID NO: 3380 - RNA, 12 nt, Artificial Sequence
  source: /note="Description of Artificial Sequence: Synthetic oligonucleotide"
ucagugaugucu

SEQ ID NO: 3381 - RNA, 12 nt, Artificial Sequence
  source: /note="Description of Artificial Sequence: Synthetic oligonucleotide"
cucagugauguc

SEQ ID NO: 3382 - RNA, 12 nt, Artificial Sequence
  source: /note="Description of Artificial Sequence: Synthetic oligonucleotide"
gcucagugaugu

SEQ ID NO: 3383 - RNA, 12 nt, Artificial Sequence
  source: /note="Description of Artificial Sequence: Synthetic oligonucleotide"
ggcucagugaug

SEQ ID NO: 3384 - RNA, 12 nt, Artificial Sequence
  source: /note="Description of Artificial Sequence: Synthetic oligonucleotide"
aggcucagugau

SEQ ID NO: 3385 - RNA, 12 nt, Artificial Sequence
  source: /note="Description of Artificial Sequence: Synthetic oligonucleotide"
acagauggcagg

SEQ ID NO: 3386 - RNA, 12 nt, Artificial Sequence
  source: /note="Description of Artificial Sequence: Synthetic oligonucleotide"
cacagauggcag

SEQ ID NO: 3387 - RNA, 12 nt, Artificial Sequence
  source: /note="Description of Artificial Sequence: Synthetic oligonucleotide"
gcacagauggca

SEQ ID NO: 3388 - RNA, 12 nt, Artificial Sequence
  source: /note="Description of Artificial Sequence: Synthetic oligonucleotide"
agcacagauggc

SEQ ID NO: 3389 - RNA, 12 nt, Artificial Sequence
  source: /note="Description of Artificial Sequence: Synthetic oligonucleotide"
gagcacagaugg

SEQ ID NO: 3390 - RNA, 12 nt, Artificial Sequence
  source: /note="Description of Artificial Sequence: Synthetic oligonucleotide"
agagcacagaug

SEQ ID NO: 3391 - RNA, 12 nt, Artificial Sequence
  source: /note="Description of Artificial Sequence: Synthetic oligonucleotide"
aagagcacagau

SEQ ID NO: 3392 - RNA, 12 nt, Artificial Sequence
  source: /note="Description of Artificial Sequence: Synthetic oligonucleotide"
gaagagcacaga

SEQ ID NO: 3393 - RNA, 12 nt, Artificial Sequence
  source: /note="Description of Artificial Sequence: Synthetic oligonucleotide"
cgaagagcacag

SEQ ID NO: 3394 - RNA, 12 nt, Artificial Sequence
  source: /note="Description of Artificial Sequence: Synthetic oligonucleotide"
acgaagagcaca

SEQ ID NO: 3395 - RNA, 12 nt, Artificial Sequence
  source: /note="Description of Artificial Sequence: Synthetic oligonucleotide"
gacgaagagcac

SEQ ID NO: 3396 - RNA, 12 nt, Artificial Sequence
  source: /note="Description of Artificial Sequence: Synthetic oligonucleotide"
ugacgaagagca

SEQ ID NO: 3397 - RNA, 12 nt, Artificial Sequence
  source: /note="Description of Artificial Sequence: Synthetic oligonucleotide"
augacgaagagc

SEQ ID NO: 3398 - RNA, 12 nt, Artificial Sequence
  source: /note="Description of Artificial Sequence: Synthetic oligonucleotide"
gaugacgaagag

SEQ ID NO: 3399 - RNA, 12 nt, Artificial Sequence
  source: /note="Description of Artificial Sequence: Synthetic oligonucleotide"
agaugacgaaga

SEQ ID NO: 3400 - RNA, 12 nt, Artificial Sequence
  source: /note="Description of Artificial Sequence: Synthetic oligonucleotide"
cagaugacgaag

SEQ ID NO: 3401 - RNA, 12 nt, Artificial Sequence
  source: /note="Description of Artificial Sequence: Synthetic oligonucleotide"
ucagaugacgaa

SEQ ID NO: 3402 - RNA, 12 nt, Artificial Sequence
  source: /note="Description of Artificial Sequence: Synthetic oligonucleotide"
gucagaugacga

SEQ ID NO: 3403 - RNA, 12 nt, Artificial Sequence
  source: /note="Description of Artificial Sequence: Synthetic oligonucleotide"
ggucagaugacg

SEQ ID NO: 3404 - RNA, 12 nt, Artificial Sequence
  source: /note="Description of Artificial Sequence: Synthetic oligonucleotide"
uggucagaugac

SEQ ID NO: 3405 - RNA, 12 nt, Artificial Sequence
  source: /note="Description of Artificial Sequence: Synthetic oligonucleotide"
cuggucagauga

SEQ ID NO: 3406 - RNA, 12 nt, Artificial Sequence
  source: /note="Description of Artificial Sequence: Synthetic oligonucleotide"
cggcuggucaga

SEQ ID NO: 3407 - RNA, 12 nt, Artificial Sequence
  source: /note="Description of Artificial Sequence: Synthetic oligonucleotide"
ucggcuggucag

SEQ ID NO: 3408 - RNA, 12 nt, Artificial Sequence
  source: /note="Description of Artificial Sequence: Synthetic oligonucleotide"
gucggcugguca

SEQ ID NO: 3409 - RNA, 12 nt, Artificial Sequence
  source: /note="Description of Artificial Sequence: Synthetic oligonucleotide"
ugucggcugguc

SEQ ID NO: 3410 - RNA, 12 nt, Artificial Sequence
  source: /note="Description of Artificial Sequence: Synthetic oligonucleotide"
gugucggcuggu

SEQ ID NO: 3411 - RNA, 12 nt, Artificial Sequence
  source: /note="Description of Artificial Sequence: Synthetic oligonucleotide"
ggugucggcugg

SEQ ID NO: 3412 - RNA, 12 nt, Artificial Sequence
  source: /note="Description of Artificial Sequence: Synthetic oligonucleotide"
uggugucggcug

SEQ ID NO: 3413 - RNA, 12 nt, Artificial Sequence
  source: /note="Description of Artificial Sequence: Synthetic oligonucleotide"
uuggugucggcu

SEQ ID NO: 3414 - RNA, 12 nt, Artificial Sequence
  source: /note="Description of Artificial Sequence: Synthetic oligonucleotide"
uucugggccauc

SEQ ID NO: 3415 - RNA, 12 nt, Artificial Sequence
  source: /note="Description of Artificial Sequence: Synthetic oligonucleotide"
auucugggccau

SEQ ID NO: 3416 - RNA, 12 nt, Artificial Sequence
  source: /note="Description of Artificial Sequence: Synthetic oligonucleotide"
acugcauucugg

SEQ ID NO: 3417 - RNA, 12 nt, Artificial Sequence
  source: /note="Description of Artificial Sequence: Synthetic oligonucleotide"
aacugcauucug

SEQ ID NO: 3418 - RNA, 12 nt, Artificial Sequence
  source: /note="Description of Artificial Sequence: Synthetic oligonucleotide"
cgaacugcauuc

SEQ ID NO: 3419 - RNA, 12 nt, Artificial Sequence
  source: /note="Description of Artificial Sequence: Synthetic oligonucleotide"
gcgaacugcauu

SEQ ID NO: 3420 - RNA, 12 nt, Artificial Sequence
  source: /note="Description of Artificial Sequence: Synthetic oligonucleotide"
ggcgaacugcau

SEQ ID NO: 3421 - RNA, 12 nt, Artificial Sequence
  source: /note="Description of Artificial Sequence: Synthetic oligonucleotide"
aggcgaacugca

SEQ ID NO: 3422 - RNA, 12 nt, Artificial Sequence
  source: /note="Description of Artificial Sequence: Synthetic oligonucleotide"
aaggcgaacugc

SEQ ID NO: 3423 - RNA, 12 nt, Artificial Sequence
  source: /note="Description of Artificial Sequence: Synthetic oligonucleotide"
gaaggcgaacug

SEQ ID NO: 3424 - RNA, 12 nt, Artificial Sequence
  source: /note="Description of Artificial Sequence: Synthetic oligonucleotide"
ugaaggcgaacu

SEQ ID NO: 3425 - RNA, 12 nt, Artificial Sequence
  source: /note="Description of Artificial Sequence: Synthetic oligonucleotide"
gugaaggcgaac

SEQ ID NO: 3426 - RNA, 12 nt, Artificial Sequence
  source: /note="Description of Artificial Sequence: Synthetic oligonucleotide"
agugaaggcgaa

SEQ ID NO: 3427 - RNA, 12 nt, Artificial Sequence
  source: /note="Description of Artificial Sequence: Synthetic oligonucleotide"
uagugaaggcga

SEQ ID NO: 3428 - RNA, 12 nt, Artificial Sequence
  source: /note="Description of Artificial Sequence: Synthetic oligonucleotide"
auagugaaggcg

SEQ ID NO: 3429 - RNA, 12 nt, Artificial Sequence
  source: /note="Description of Artificial Sequence: Synthetic oligonucleotide"
aguccauaguga

SEQ ID NO: 3430 - RNA, 12 nt, Artificial Sequence
  source: /note="Description of Artificial Sequence: Synthetic oligonucleotide"
uaguccauagug

SEQ ID NO: 3431 - RNA, 12 nt, Artificial Sequence
  source: /note="Description of Artificial Sequence: Synthetic oligonucleotide"
acugguagucca

SEQ ID NO: 3432 - RNA, 12 nt, Artificial Sequence
  source: /note="Description of Artificial Sequence: Synthetic oligonucleotide"
aacugguagucc

SEQ ID NO: 3433 - RNA, 12 nt, Artificial Sequence
  source: /note="Description of Artificial Sequence: Synthetic oligonucleotide"
caacugguaguc

SEQ ID NO: 3434 - RNA, 12 nt, Artificial Sequence
  source: /note="Description of Artificial Sequence: Synthetic oligonucleotide"
acaacugguagu

SEQ ID NO: 3435 - RNA, 12 nt, Artificial Sequence
  source: /note="Description of Artificial Sequence: Synthetic oligonucleotide"
cacaacugguag

SEQ ID NO: 3436 - RNA, 12 nt, Artificial Sequence
  source: /note="Description of Artificial Sequence: Synthetic oligonucleotide"
ccacaacuggua

SEQ ID NO: 3437 - RNA, 12 nt, Artificial Sequence
  source: /note="Description of Artificial Sequence: Synthetic oligonucleotide"
accacaacuggu

SEQ ID NO: 3438 - RNA, 12 nt, Artificial Sequence
  source: /note="Description of Artificial Sequence: Synthetic oligonucleotide"
aaccacaacugg

SEQ ID NO: 3439 - RNA, 12 nt, Artificial Sequence
  source: /note="Description of Artificial Sequence: Synthetic oligonucleotide"
uaaccacaacug

SEQ ID NO: 3440 - RNA, 12 nt, Artificial Sequence
  source: /note="Description of Artificial Sequence: Synthetic oligonucleotide"
uuaaccacaacu

SEQ ID NO: 3441 - RNA, 12 nt, Artificial Sequence
  source: /note="Description of Artificial Sequence: Synthetic oligonucleotide"
cuuaaccacaac

SEQ ID NO: 3442 - RNA, 12 nt, Artificial Sequence
  source: /note="Description of Artificial Sequence: Synthetic oligonucleotide"
gcuuaaccacaa

SEQ ID NO: 3443 - RNA, 12 nt, Artificial Sequence
  source: /note="Description of Artificial Sequence: Synthetic oligonucleotide"
agcuuaaccaca

SEQ ID NO: 3444 - RNA, 12 nt, Artificial Sequence
  source: /note="Description of Artificial Sequence: Synthetic oligonucleotide"
gagcuuaaccac

SEQ ID NO: 3445 - RNA, 12 nt, Artificial Sequence
  source: /note="Description of Artificial Sequence: Synthetic oligonucleotide"
agagcuuaacca

SEQ ID NO: 3446 - RNA, 12 nt, Artificial Sequence
  source: /note="Description of Artificial Sequence: Synthetic oligonucleotide"
aagagcuuaacc

SEQ ID NO: 3447 - RNA, 12 nt, Artificial Sequence
  source: /note="Description of Artificial Sequence: Synthetic oligonucleotide"
ggccagugggau

SEQ ID NO: 3448 - RNA, 12 nt, Artificial Sequence
  source: /note="Description of Artificial Sequence: Synthetic oligonucleotide"
aggccaguggga

SEQ ID NO: 3449 - RNA, 12 nt, Artificial Sequence
  source: /note="Description of Artificial Sequence: Synthetic oligonucleotide"
gaggccaguggg

SEQ ID NO: 3450 - RNA, 12 nt, Artificial Sequence
  source: /note="Description of Artificial Sequence: Synthetic oligonucleotide"
agaggccagugg

SEQ ID NO: 3451 - RNA, 12 nt, Artificial Sequence
  source: /note="Description of Artificial Sequence: Synthetic oligonucleotide"
cagaggccagug

SEQ ID NO: 3452 - RNA, 12 nt, Artificial Sequence
  source: /note="Description of Artificial Sequence: Synthetic oligonucleotide"
ucagaggccagu

SEQ ID NO: 3453 - RNA, 12 nt, Artificial Sequence
  source: /note="Description of Artificial Sequence: Synthetic oligonucleotide"
aucagaggccag

SEQ ID NO: 3454 - RNA, 12 nt, Artificial Sequence
  source: /note="Description of Artificial Sequence: Synthetic oligonucleotide"
uaucagaggcca

SEQ ID NO: 3455 - RNA, 12 nt, Artificial Sequence
  source: /note="Description of Artificial Sequence: Synthetic oligonucleotide"
uuaucagaggcc

SEQ ID NO: 3456 - RNA, 12 nt, Artificial Sequence
  source: /note="Description of Artificial Sequence: Synthetic oligonucleotide"
uuuaucagaggc

SEQ ID NO: 3457 - RNA, 12 nt, Artificial Sequence
  source: /note="Description of Artificial Sequence: Synthetic oligonucleotide"
cuuuaucagagg

SEQ ID NO: 3458 - RNA, 12 nt, Artificial Sequence
  source: /note="Description of Artificial Sequence: Synthetic oligonucleotide"
ccuuuaucagag

SEQ ID NO: 3459 - RNA, 12 nt, Artificial Sequence
  source: /note="Description of Artificial Sequence: Synthetic oligonucleotide"
gccuuuaucaga

SEQ ID NO: 3460 - RNA, 12 nt, Artificial Sequence
  source: /note="Description of Artificial Sequence: Synthetic oligonucleotide"
agccuuuaucag

SEQ ID NO: 3461 - RNA, 12 nt, Artificial Sequence
  source: /note="Description of Artificial Sequence: Synthetic oligonucleotide"
uagccuuuauca

SEQ ID NO: 3462 - RNA, 12 nt, Artificial Sequence
  source: /note="Description of Artificial Sequence: Synthetic oligonucleotide"
aguagccuuuau

SEQ ID NO: 3463 - RNA, 12 nt, Artificial Sequence
  source: /note="Description of Artificial Sequence: Synthetic oligonucleotide"
caguagccuuua

SEQ ID NO: 3464 - RNA, 12 nt, Artificial Sequence
  source: /note="Description of Artificial Sequence: Synthetic oligonucleotide"
acaguagccuuu

SEQ ID NO: 3465 - RNA, 12 nt, Artificial Sequence
  source: /note="Description of Artificial Sequence: Synthetic oligonucleotide"
aacaguagccuu

SEQ ID NO: 3466 - RNA, 12 nt, Artificial Sequence
  source: /note="Description of Artificial Sequence: Synthetic oligonucleotide"
ccaacaguagcc

SEQ ID NO: 3467 - RNA, 12 nt, Artificial Sequence
  source: /note="Description of Artificial Sequence: Synthetic oligonucleotide"
uccaacaguagc

SEQ ID NO: 3468 - RNA, 12 nt, Artificial Sequence
  source: /note="Description of Artificial Sequence: Synthetic oligonucleotide"
auccaacaguag

SEQ ID NO: 3469 - RNA, 12 nt, Artificial Sequence
  source: /note="Description of Artificial Sequence: Synthetic oligonucleotide"
caauccaacagu

SEQ ID NO: 3470 - RNA, 12 nt, Artificial Sequence
  source: /note="Description of Artificial Sequence: Synthetic oligonucleotide"
ucaauccaacag

SEQ ID NO: 3471 - RNA, 12 nt, Artificial Sequence
  source: /note="Description of Artificial Sequence: Synthetic oligonucleotide"
aucaauccaaca

SEQ ID NO: 3472 - RNA, 12 nt, Artificial Sequence
  source: /note="Description of Artificial Sequence: Synthetic oligonucleotide"
aaucaauccaac

SEQ ID NO: 3473 - RNA, 12 nt, Artificial Sequence
  source: /note="Description of Artificial Sequence: Synthetic oligonucleotide"
gaaucaauccaa

SEQ ID NO: 3474 - RNA, 12 nt, Artificial Sequence
  source: /note="Description of Artificial Sequence: Synthetic oligonucleotide"
cgaaucaaucca

SEQ ID NO: 3475 - RNA, 12 nt, Artificial Sequence
  source: /note="Description of Artificial Sequence: Synthetic oligonucleotide"
ucgaaucaaucc

SEQ ID NO: 3476 - RNA, 12 nt, Artificial Sequence
  source: /note="Description of Artificial Sequence: Synthetic oligonucleotide"
uucgaaucaauc

SEQ ID NO: 3477 - RNA, 12 nt, Artificial Sequence
  source: /note="Description of Artificial Sequence: Synthetic oligonucleotide"
uuucgaaucaau

SEQ ID NO: 3478 - RNA, 12 nt, Artificial Sequence
  source: /note="Description of Artificial Sequence: Synthetic oligonucleotide"
auuucgaaucaa

SEQ ID NO: 3479 - RNA, 12 nt, Artificial Sequence
  source: /note="Description of Artificial Sequence: Synthetic oligonucleotide"
cccugcucacgc

SEQ ID NO: 3480 - RNA, 12 nt, Artificial Sequence
  source: /note="Description of Artificial Sequence: Synthetic oligonucleotide"
acccugcucacg

SEQ ID NO: 3481 - RNA, 12 nt, Artificial Sequence
  source: /note="Description of Artificial Sequence: Synthetic oligonucleotide"
cacccugcucac

SEQ ID NO: 3482 - RNA, 12 nt, Artificial Sequence
  source: /note="Description of Artificial Sequence: Synthetic oligonucleotide"
gcacccugcuca

SEQ ID NO: 3483 - RNA, 12 nt, Artificial Sequence
  source: /note="Description of Artificial Sequence: Synthetic oligonucleotide"
ggcacccugcuc

SEQ ID NO: 3484 - RNA, 12 nt, Artificial Sequence
  source: /note="Description of Artificial Sequence: Synthetic oligonucleotide"
uggcacccugcu

SEQ ID NO: 3485 - RNA, 12 nt, Artificial Sequence
  source: /note="Description of Artificial Sequence: Synthetic oligonucleotide"
auggcacccugc

SEQ ID NO: 3486 - RNA, 12 nt, Artificial Sequence
  source: /note="Description of Artificial Sequence: Synthetic oligonucleotide"
guggaauggcac

SEQ ID NO: 3487 - RNA, 12 nt, Artificial Sequence
  source: /note="Description of Artificial Sequence: Synthetic oligonucleotide"
cguggaauggca

SEQ ID NO: 3488 - RNA, 12 nt, Artificial Sequence
  source: /note="Description of Artificial Sequence: Synthetic oligonucleotide"
ucguggaauggc

SEQ ID NO: 3489 - RNA, 12 nt, Artificial Sequence
  source: /note="Description of Artificial Sequence: Synthetic oligonucleotide"
gucguggaaugg

SEQ ID NO: 3490 - RNA, 12 nt, Artificial Sequence
  source: /note="Description of Artificial Sequence: Synthetic oligonucleotide"
agucguggaaug

SEQ ID NO: 3491 - RNA, 12 nt, Artificial Sequence
  source: /note="Description of Artificial Sequence: Synthetic oligonucleotide"
uagucguggaau

SEQ ID NO: 3492 - RNA, 12 nt, Artificial Sequence
  source: /note="Description of Artificial Sequence: Synthetic oligonucleotide"
cuagucguggaa

SEQ ID NO: 3493 - RNA, 12 nt, Artificial Sequence
  source: /note="Description of Artificial Sequence: Synthetic oligonucleotide"
acuagucgugga

SEQ ID NO: 3494 - RNA, 12 nt, Artificial Sequence
  source: /note="Description of Artificial Sequence: Synthetic oligonucleotide"
aacuagucgugg

SEQ ID NO: 3495 - RNA, 12 nt, Artificial Sequence
  source: /note="Description of Artificial Sequence: Synthetic oligonucleotide"
gaacuagucgug

SEQ ID NO: 3496 - RNA, 12 nt, Artificial Sequence
  source: /note="Description of Artificial Sequence: Synthetic oligonucleotide"
ugaacuagucgu

SEQ ID NO: 3497 - RNA, 12 nt, Artificial Sequence
  source: /note="Description of Artificial Sequence: Synthetic oligonucleotide"
cugaacuagucg

SEQ ID NO: 3498 - RNA, 12 nt, Artificial Sequence
  source: /note="Description of Artificial Sequence: Synthetic oligonucleotide"
acugaacuaguc

SEQ ID NO: 3499 - RNA, 12 nt, Artificial Sequence
  source: /note="Description of Artificial Sequence: Synthetic oligonucleotide"
aacugaacuagu

SEQ ID NO: 3500 - RNA, 12 nt, Artificial Sequence
  source: /note="Description of Artificial Sequence: Synthetic oligonucleotide"
caacugaacuag

SEQ ID NO: 3501 - RNA, 12 nt, Artificial Sequence
  source: /note="Description of Artificial Sequence: Synthetic oligonucleotide"
gcaacugaacua

SEQ ID NO: 3502 - RNA, 12 nt, Artificial Sequence
  source: /note="Description of Artificial Sequence: Synthetic oligonucleotide"
agcaacugaacu

SEQ ID NO: 3503 - RNA, 12 nt, Artificial Sequence
  source: /note="Description of Artificial Sequence: Synthetic oligonucleotide"
aagcaacugaac

SEQ ID NO: 3504 - RNA, 12 nt, Artificial Sequence
  source: /note="Description of Artificial Sequence: Synthetic oligonucleotide"
caagcaacugaa

SEQ ID NO: 3505 - RNA, 12 nt, Artificial Sequence
  source: /note="Description of Artificial Sequence: Synthetic oligonucleotide"
acaagcaacuga

SEQ ID NO: 3506 - RNA, 12 nt, Artificial Sequence
  source: /note="Description of Artificial Sequence: Synthetic oligonucleotide"
aacaagcaacug

SEQ ID NO: 3507 - RNA, 12 nt, Artificial Sequence
  source: /note="Description of Artificial Sequence: Synthetic oligonucleotide"
cgaacaagcaac

SEQ ID NO: 3508 - RNA, 12 nt, Artificial Sequence
  source: /note="Description of Artificial Sequence: Synthetic oligonucleotide"
acgaacaagcaa

SEQ ID NO: 3509 - RNA, 12 nt, Artificial Sequence
  source: /note="Description of Artificial Sequence: Synthetic oligonucleotide"
ugugcacgaaca

SEQ ID NO: 3510 - RNA, 12 nt, Artificial Sequence
  source: /note="Description of Artificial Sequence: Synthetic oligonucleotide"
augugcacgaac

SEQ ID NO: 3511 - RNA, 12 nt, Artificial Sequence
  source: /note="Description of Artificial Sequence: Synthetic oligonucleotide"
gaugugcacgaa

SEQ ID NO: 3512 - RNA, 12 nt, Artificial Sequence
  source: /note="Description of Artificial Sequence: Synthetic oligonucleotide"
ugaugugcacga

SEQ ID NO: 3513 - RNA, 12 nt, Artificial Sequence
  source: /note="Description of Artificial Sequence: Synthetic oligonucleotide"
cugaugugcacg

SEQ ID NO: 3514 - RNA, 12 nt, Artificial Sequence
  source: /note="Description of Artificial Sequence: Synthetic oligonucleotide"
ccugaugugcac

SEQ ID NO: 3515 - RNA, 12 nt, Artificial Sequence
  source: /note="Description of Artificial Sequence: Synthetic oligonucleotide"
uccugaugugca

SEQ ID NO: 3516 - RNA, 12 nt, Artificial Sequence
  source: /note="Description of Artificial Sequence: Synthetic oligonucleotide"
auccugaugugc

SEQ ID NO: 3517 - RNA, 12 nt, Artificial Sequence
  source: /note="Description of Artificial Sequence: Synthetic oligonucleotide"
uacggcgcuggg

SEQ ID NO: 3518 - RNA, 12 nt, Artificial Sequence
  source: /note="Description of Artificial Sequence: Synthetic oligonucleotide"
guacggcgcugg

SEQ ID NO: 3519 - RNA, 12 nt, Artificial Sequence
  source: /note="Description of Artificial Sequence: Synthetic oligonucleotide"
cguacggcgcug

SEQ ID NO: 3520 - RNA, 12 nt, Artificial Sequence
  source: /note="Description of Artificial Sequence: Synthetic oligonucleotide"
acguacggcgcu

SEQ ID NO: 3521 - RNA, 12 nt, Artificial Sequence
  source: /note="Description of Artificial Sequence: Synthetic oligonucleotide"
gacguacggcgc

SEQ ID NO: 3522 - RNA, 12 nt, Artificial Sequence
  source: /note="Description of Artificial Sequence: Synthetic oligonucleotide"
ggacguacggcg

SEQ ID NO: 3523 - RNA, 12 nt, Artificial Sequence
  source: /note="Description of Artificial Sequence: Synthetic oligonucleotide"
cugugucccacc

SEQ ID NO: 3524 - RNA, 12 nt, Artificial Sequence
  source: /note="Description of Artificial Sequence: Synthetic oligonucleotide"
gcugugucccac

SEQ ID NO: 3525 - RNA, 12 nt, Artificial Sequence
  source: /note="Description of Artificial Sequence: Synthetic oligonucleotide"
ugcuguguccca

SEQ ID NO: 3526 - RNA, 12 nt, Artificial Sequence
  source: /note="Description of Artificial Sequence: Synthetic oligonucleotide"
cugcuguguccc

SEQ ID NO: 3527 - RNA, 12 nt, Artificial Sequence
  source: /note="Description of Artificial Sequence: Synthetic oligonucleotide"
gcugcugugucc

SEQ ID NO: 3528 - RNA, 12 nt, Artificial Sequence
  source: /note="Description of Artificial Sequence: Synthetic oligonucleotide"
ugcugcuguguc

SEQ ID NO: 3529 - RNA, 12 nt, Artificial Sequence
  source: /note="Description of Artificial Sequence: Synthetic oligonucleotide"
uugcugcugugu

SEQ ID NO: 3530 - RNA, 12 nt, Artificial Sequence
  source: /note="Description of Artificial Sequence: Synthetic oligonucleotide"
auugcugcugug

SEQ ID NO: 3531 - RNA, 12 nt, Artificial Sequence
  source: /note="Description of Artificial Sequence: Synthetic oligonucleotide"
aauugcugcugu

SEQ ID NO: 3532 - RNA, 12 nt, Artificial Sequence
  source: /note="Description of Artificial Sequence: Synthetic oligonucleotide"
ccaugcggaccc

SEQ ID NO: 3533 - RNA, 12 nt, Artificial Sequence
  source: /note="Description of Artificial Sequence: Synthetic oligonucleotide"
uccaugcggacc

SEQ ID NO: 3534 - RNA, 12 nt, Artificial Sequence
  source: /note="Description of Artificial Sequence: Synthetic oligonucleotide"
uuccaugcggac

SEQ ID NO: 3535 - RNA, 12 nt, Artificial Sequence
  source: /note="Description of Artificial Sequence: Synthetic oligonucleotide"
cuuccaugcgga

SEQ ID NO: 3536 - RNA, 12 nt, Artificial Sequence
  source: /note="Description of Artificial Sequence: Synthetic oligonucleotide"
ucuuccaugcgg

SEQ ID NO: 3537 - RNA, 12 nt, Artificial Sequence
  source: /note="Description of Artificial Sequence: Synthetic oligonucleotide"
uucuuccaugcg

SEQ ID NO: 3538 - RNA, 12 nt, Artificial Sequence
  source: /note="Description of Artificial Sequence: Synthetic oligonucleotide"
uuucuuccaugc

SEQ ID NO: 3539 - RNA, 12 nt, Artificial Sequence
  source: /note="Description of Artificial Sequence: Synthetic oligonucleotide"
cgagcuaggaug

SEQ ID NO: 3540 - RNA, 12 nt, Artificial Sequence
  source: /note="Description of Artificial Sequence: Synthetic oligonucleotide"
ccgagcuaggau

SEQ ID NO: 3541 - RNA, 12 nt, Artificial Sequence
  source: /note="Description of Artificial Sequence: Synthetic oligonucleotide"
cccgagcuagga

SEQ ID NO: 3542 - RNA, 12 nt, Artificial Sequence
  source: /note="Description of Artificial Sequence: Synthetic oligonucleotide"
ucccgagcuagg

SEQ ID NO: 3543 - RNA, 12 nt, Artificial Sequence
  source: /note="Description of Artificial Sequence: Synthetic oligonucleotide"
aucccgagcuag

SEQ ID NO: 3544 - RNA, 12 nt, Artificial Sequence
  source: /note="Description of Artificial Sequence: Synthetic oligonucleotide"
caucccgagcua

SEQ ID NO: 3545 - RNA, 12 nt, Artificial Sequence
  source: /note="Description of Artificial Sequence: Synthetic oligonucleotide"
acaucccgagcu

SEQ ID NO: 3546 - RNA, 12 nt, Artificial Sequence
  source: /note="Description of Artificial Sequence: Synthetic oligonucleotide"
aacaucccgagc

SEQ ID NO: 3547 - RNA, 12 nt, Artificial Sequence
  source: /note="Description of Artificial Sequence: Synthetic oligonucleotide"
gugaacaucccg

SEQ ID NO: 3548 - RNA, 12 nt, Artificial Sequence
  source: /note="Description of Artificial Sequence: Synthetic oligonucleotide"
ugugaacauccc

SEQ ID NO: 3549 - RNA, 12 nt, Artificial Sequence
  source: /note="Description of Artificial Sequence: Synthetic oligonucleotide"
uugugaacaucc

SEQ ID NO: 3550 - RNA, 12 nt, Artificial Sequence
  source: /note="Description of Artificial Sequence: Synthetic oligonucleotide"
guugugaacauc

SEQ ID NO: 3551 - RNA, 12 nt, Artificial Sequence
  source: /note="Description of Artificial Sequence: Synthetic oligonucleotide"
gguugugaacau

SEQ ID NO: 3552 - RNA, 12 nt, Artificial Sequence
  source: /note="Description of Artificial Sequence: Synthetic oligonucleotide"
cgguugugaaca

SEQ ID NO: 3553 - RNA, 12 nt, Artificial Sequence
  source: /note="Description of Artificial Sequence: Synthetic oligonucleotide"
ucgguugugaac

SEQ ID NO: 3554 - RNA, 12 nt, Artificial Sequence
  source: /note="Description of Artificial Sequence: Synthetic oligonucleotide"
uucgguugugaa

SEQ ID NO: 3555 - RNA, 12 nt, Artificial Sequence
  source: /note="Description of Artificial Sequence: Synthetic oligonucleotide"
auucgguuguga

SEQ ID NO: 3556 - RNA, 12 nt, Artificial Sequence
  source: /note="Description of Artificial Sequence: Synthetic oligonucleotide"
aauucgguugug

SEQ ID NO: 3557 - RNA, 12 nt, Artificial Sequence
  source: /note="Description of Artificial Sequence: Synthetic oligonucleotide"
gguauuuagucc

SEQ ID NO: 3558 - RNA, 12 nt, Artificial Sequence
  source: /note="Description of Artificial Sequence: Synthetic oligonucleotide"
ugguauuuaguc

SEQ ID NO: 3559 - RNA, 12 nt, Artificial Sequence
  source: /note="Description of Artificial Sequence: Synthetic oligonucleotide"
augguauuuagu

SEQ ID NO: 3560 - RNA, 12 nt, Artificial Sequence
  source: /note="Description of Artificial Sequence: Synthetic oligonucleotide"
aaugguauuuag

SEQ ID NO: 3561 - RNA, 12 nt, Artificial Sequence
  source: /note="Description of Artificial Sequence: Synthetic oligonucleotide"
gaaugguauuua

SEQ ID NO: 3562 - RNA, 12 nt, Artificial Sequence
  source: /note="Description of Artificial Sequence: Synthetic oligonucleotide"
ggaaugguauuu

SEQ ID NO: 3563 - RNA, 12 nt, Artificial Sequence
  source: /note="Description of Artificial Sequence: Synthetic oligonucleotide"
uggaaugguauu

SEQ ID NO: 3564 - RNA, 12 nt, Artificial Sequence
  source: /note="Description of Artificial Sequence: Synthetic oligonucleotide"
auggaaugguau

SEQ ID NO: 3565 - RNA, 12 nt, Artificial Sequence
  source: /note="Description of Artificial Sequence: Synthetic oligonucleotide"
aauggaauggua

SEQ ID NO: 3566 - RNA, 12 nt, Artificial Sequence
  source: /note="Description of Artificial Sequence: Synthetic oligonucleotide"
caauggaauggu

SEQ ID NO: 3567 - RNA, 12 nt, Artificial Sequence
  source: /note="Description of Artificial Sequence: Synthetic oligonucleotide"
acaauggaaugg

SEQ ID NO: 3568 - RNA, 12 nt, Artificial Sequence
  source: /note="Description of Artificial Sequence: Synthetic oligonucleotide"
aacaauggaaug

SEQ ID NO: 3569 - RNA, 12 nt, Artificial Sequence
  source: /note="Description of Artificial Sequence: Synthetic oligonucleotide"
aaacaauggaau

SEQ ID NO: 3570 - RNA, 12 nt, Artificial Sequence
  source: /note="Description of Artificial Sequence: Synthetic oligonucleotide"
caaacaauggaa

SEQ ID NO: 3571 - RNA, 12 nt, Artificial Sequence
  source: /note="Description of Artificial Sequence: Synthetic oligonucleotide"
acaaacaaugga

SEQ ID NO: 3572 - RNA, 12 nt, Artificial Sequence
  source: /note="Description of Artificial Sequence: Synthetic oligonucleotide"
cugcacaaacaa

SEQ ID NO: 3573 - RNA, 12 nt, Artificial Sequence
  source: /note="Description of Artificial Sequence: Synthetic oligonucleotide"
gcugcacaaaca

SEQ ID NO: 3574 - RNA, 12 nt, Artificial Sequence
  source: /note="Description of Artificial Sequence: Synthetic oligonucleotide"
agcugcacaaac

SEQ ID NO: 3575 - RNA, 12 nt, Artificial Sequence
  source: /note="Description of Artificial Sequence: Synthetic oligonucleotide"
cagcugcacaaa

SEQ ID NO: 3576 - RNA, 12 nt, Artificial Sequence
  source: /note="Description of Artificial Sequence: Synthetic oligonucleotide"
gcagcugcacaa

SEQ ID NO: 3577 - RNA, 12 nt, Artificial Sequence
  source: /note="Description of Artificial Sequence: Synthetic oligonucleotide"
agcagcugcaca

SEQ ID NO: 3578 - RNA, 12 nt, Artificial Sequence
  source: /note="Description of Artificial Sequence: Synthetic oligonucleotide"
aagcagcugcac

SEQ ID NO: 3579 - RNA, 12 nt, Artificial Sequence
  source: /note="Description of Artificial Sequence: Synthetic oligonucleotide"
aaagcagcugca

SEQ ID NO: 3580 - RNA, 12 nt, Artificial Sequence
  source: /note="Description of Artificial Sequence: Synthetic oligonucleotide"
uaaagcagcugc

SEQ ID NO: 3581 - RNA, 12 nt, Artificial Sequence
  source: /note="Description of Artificial Sequence: Synthetic oligonucleotide"
auaaagcagcug

SEQ ID NO: 3582 - RNA, 12 nt, Artificial Sequence
  source: /note="Description of Artificial Sequence: Synthetic oligonucleotide"
aauaaagcagcu

SEQ ID NO: 3583 - RNA, 12 nt, Artificial Sequence
  source: /note="Description of Artificial Sequence: Synthetic oligonucleotide"
gaauaaagcagc

SEQ ID NO: 3584 - RNA, 12 nt, Artificial Sequence
  source: /note="Description of Artificial Sequence: Synthetic oligonucleotide"
agaauaaagcag

SEQ ID NO: 3585 - RNA, 12 nt, Artificial Sequence
  source: /note="Description of Artificial Sequence: Synthetic oligonucleotide"
gagaauaaagca

SEQ ID NO: 3586 - RNA, 12 nt, Artificial Sequence
  source: /note="Description of Artificial Sequence: Synthetic oligonucleotide"
ggagaauaaagc

SEQ ID NO: 3587 - RNA, 12 nt, Artificial Sequence
  source: /note="Description of Artificial Sequence: Synthetic oligonucleotide"
gggagaauaaag

SEQ ID NO: 3588 - RNA, 12 nt, Artificial Sequence
  source: /note="Description of Artificial Sequence: Synthetic oligonucleotide"
ugggagaauaaa

SEQ ID NO: 3589 - RNA, 12 nt, Artificial Sequence
  source: /note="Description of Artificial Sequence: Synthetic oligonucleotide"
augggagaauaa

SEQ ID NO: 3590 - RNA, 12 nt, Artificial Sequence
  source: /note="Description of Artificial Sequence: Synthetic oligonucleotide"
aaugggagaaua

SEQ ID NO: 3591 - RNA, 12 nt, Artificial Sequence
  source: /note="Description of Artificial Sequence: Synthetic oligonucleotide"
caaugggagaau

SEQ ID NO: 3592 - RNA, 12 nt, Artificial Sequence
  source: /note="Description of Artificial Sequence: Synthetic oligonucleotide"
ucaaugggagaa

SEQ ID NO: 3593 - RNA, 12 nt, Artificial Sequence
  source: /note="Description of Artificial Sequence: Synthetic oligonucleotide"
uucaaugggaga

SEQ ID NO: 3594 - RNA, 12 nt, Artificial Sequence
  source: /note="Description of Artificial Sequence: Synthetic oligonucleotide"
uuucaaugggag

SEQ ID NO: 3595 - RNA, 12 nt, Artificial Sequence
  source: /note="Description of Artificial Sequence: Synthetic oligonucleotide"
uuuucaauggga

SEQ ID NO: 3596 - RNA, 12 nt, Artificial Sequence
  source: /note="Description of Artificial Sequence: Synthetic oligonucleotide"
guuuucaauggg

SEQ ID NO: 3597 - RNA, 12 nt, Artificial Sequence
  source: /note="Description of Artificial Sequence: Synthetic oligonucleotide"
uguuuucaaugg

SEQ ID NO: 3598 - RNA, 12 nt, Artificial Sequence
  source: /note="Description of Artificial Sequence: Synthetic oligonucleotide"
auguuuucaaug

SEQ ID NO: 3599 - RNA, 12 nt, Artificial Sequence
  source: /note="Description of Artificial Sequence: Synthetic oligonucleotide"
gcagcuacucuu

SEQ ID NO: 3600 - RNA, 12 nt, Artificial Sequence
  source: /note="Description of Artificial Sequence: Synthetic oligonucleotide"
ugcagcuacucu

SEQ ID NO: 3601 - RNA, 12 nt, Artificial Sequence
  source: /note="Description of Artificial Sequence: Synthetic oligonucleotide"
cugcagcuacuc

SEQ ID NO: 3602 - RNA, 12 nt, Artificial Sequence
  source: /note="Description of Artificial Sequence: Synthetic oligonucleotide"
cccugcagcuac

SEQ ID NO: 3603 - RNA, 12 nt, Artificial Sequence
  source: /note="Description of Artificial Sequence: Synthetic oligonucleotide"
ccccugcagcua

SEQ ID NO: 3604 - RNA, 12 nt, Artificial Sequence
  source: /note="Description of Artificial Sequence: Synthetic oligonucleotide"
accccugcagcu

SEQ ID NO: 3605 - RNA, 12 nt, Artificial Sequence
  source: /note="Description of Artificial Sequence: Synthetic oligonucleotide"
gaccccugcagc

SEQ ID NO: 3606 - RNA, 12 nt, Artificial Sequence
  source: /note="Description of Artificial Sequence: Synthetic oligonucleotide"
ggaccccugcag

SEQ ID NO: 3607 - RNA, 12 nt, Artificial Sequence
  source: /note="Description of Artificial Sequence: Synthetic oligonucleotide"
aggaccccugca

SEQ ID NO: 3608 - RNA, 12 nt, Artificial Sequence
  source: /note="Description of Artificial Sequence: Synthetic oligonucleotide"
gaggaccccugc

SEQ ID NO: 3609 - RNA, 12 nt, Artificial Sequence
  source: /note="Description of Artificial Sequence: Synthetic oligonucleotide"
agaggaccccug

SEQ ID NO: 3610 - RNA, 12 nt, Artificial Sequence
  source: /note="Description of Artificial Sequence: Synthetic oligonucleotide"
cagaggaccccu

SEQ ID NO: 3611 - RNA, 12 nt, Artificial Sequence
  source: /note="Description of Artificial Sequence: Synthetic oligonucleotide"
acagaggacccc

SEQ ID NO: 3612 - RNA, 12 nt, Artificial Sequence
  source: /note="Description of Artificial Sequence: Synthetic oligonucleotide"
cacagaggaccc

SEQ ID NO: 3613 - RNA, 12 nt, Artificial Sequence
  source: /note="Description of Artificial Sequence: Synthetic oligonucleotide"
ucacagaggacc

SEQ ID NO: 3614 - RNA, 12 nt, Artificial Sequence
  source: /note="Description of Artificial Sequence: Synthetic oligonucleotide"
uucacagaggac

SEQ ID NO: 3615 - RNA, 12 nt, Artificial Sequence
  source: /note="Description of Artificial Sequence: Synthetic oligonucleotide"
guucacagagga

SEQ ID NO: 3616 - RNA, 12 nt, Artificial Sequence
  source: /note="Description of Artificial Sequence: Synthetic oligonucleotide"
aguucacagagg

SEQ ID NO: 3617 - RNA, 12 nt, Artificial Sequence
  source: /note="Description of Artificial Sequence: Synthetic oligonucleotide"
aaguucacagag

SEQ ID NO: 3618 - RNA, 12 nt, Artificial Sequence
  source: /note="Description of Artificial Sequence: Synthetic oligonucleotide"
caaguucacaga

SEQ ID NO: 3619 - RNA, 12 nt, Artificial Sequence
  source: /note="Description of Artificial Sequence: Synthetic oligonucleotide"
gcaaguucacag

SEQ ID NO: 3620 - RNA, 12 nt, Artificial Sequence
  source: /note="Description of Artificial Sequence: Synthetic oligonucleotide"
agcaaguucaca

SEQ ID NO: 3621 - RNA, 12 nt, Artificial Sequence
  source: /note="Description of Artificial Sequence: Synthetic oligonucleotide"
gagcaaguucac

SEQ ID NO: 3622 - RNA, 12 nt, Artificial Sequence
  source: /note="Description of Artificial Sequence: Synthetic oligonucleotide"
ugagcaaguuca

SEQ ID NO: 3623 - RNA, 12 nt, Artificial Sequence
  source: /note="Description of Artificial Sequence: Synthetic oligonucleotide"
cugagcaaguuc

SEQ ID NO: 3624 - RNA, 12 nt, Artificial Sequence
  source: /note="Description of Artificial Sequence: Synthetic oligonucleotide"
ccugagcaaguu

SEQ ID NO: 3625 - RNA, 12 nt, Artificial Sequence
  source: /note="Description of Artificial Sequence: Synthetic oligonucleotide"
uccugagcaagu

SEQ ID NO: 3626 - RNA, 12 nt, Artificial Sequence
  source: /note="Description of Artificial Sequence: Synthetic oligonucleotide"
guccugagcaag

SEQ ID NO: 3627 - RNA, 12 nt, Artificial Sequence
  source: /note="Description of Artificial Sequence: Synthetic oligonucleotide"
uguccugagcaa

SEQ ID NO: 3628 - RNA, 12 nt, Artificial Sequence
  source: /note="Description of Artificial Sequence: Synthetic oligonucleotide"
uuguccugagca

SEQ ID NO: 3629 - RNA, 12 nt, Artificial Sequence
  source: /note="Description of Artificial Sequence: Synthetic oligonucleotide"
cuuguccugagc

SEQ ID NO: 3630 - RNA, 12 nt, Artificial Sequence
  source: /note="Description of Artificial Sequence: Synthetic oligonucleotide"
ccuuguccugag

SEQ ID NO: 3631 - RNA, 12 nt, Artificial Sequence
  source: /note="Description of Artificial Sequence: Synthetic oligonucleotide"
uccuuguccuga

SEQ ID NO: 3632 - RNA, 12 nt, Artificial Sequence
  source: /note="Description of Artificial Sequence: Synthetic oligonucleotide"
gucagaggagcu

SEQ ID NO: 3633 - RNA, 12 nt, Artificial Sequence
  source: /note="Description of Artificial Sequence: Synthetic oligonucleotide"
ugucagaggagc

SEQ ID NO: 3634 - RNA, 12 nt, Artificial Sequence
  source: /note="Description of Artificial Sequence: Synthetic oligonucleotide"
cugucagaggag

SEQ ID NO: 3635 - RNA, 12 nt, Artificial Sequence
  source: /note="Description of Artificial Sequence: Synthetic oligonucleotide"
ucugucagagga

SEQ ID NO: 3636 - RNA, 12 nt, Artificial Sequence
  source: /note="Description of Artificial Sequence: Synthetic oligonucleotide"
cucugucagagg

SEQ ID NO: 3637 - RNA, 12 nt, Artificial Sequence
  source: /note="Description of Artificial Sequence: Synthetic oligonucleotide"
acucugucagag

SEQ ID NO: 3638 - RNA, 12 nt, Artificial Sequence
  source: /note="Description of Artificial Sequence: Synthetic oligonucleotide"
aacucugucaga

SEQ ID NO: 3639 - RNA, 12 nt, Artificial Sequence
  source: /note="Description of Artificial Sequence: Synthetic oligonucleotide"
uaacucugucag

SEQ ID NO: 3640 - RNA, 12 nt, Artificial Sequence
  source: /note="Description of Artificial Sequence: Synthetic oligonucleotide"
aaguaacucugu

SEQ ID NO: 3641 - RNA, 12 nt, Artificial Sequence
  source: /note="Description of Artificial Sequence: Synthetic oligonucleotide"
gugaaguaacuc

SEQ ID NO: 3642 - RNA, 12 nt, Artificial Sequence
  source: /note="Description of Artificial Sequence: Synthetic oligonucleotide"
agugaaguaacu

SEQ ID NO: 3643 - RNA, 12 nt, Artificial Sequence
  source: /note="Description of Artificial Sequence: Synthetic oligonucleotide"
gagugaaguaac

SEQ ID NO: 3644 - RNA, 12 nt, Artificial Sequence
  source: /note="Description of Artificial Sequence: Synthetic oligonucleotide"
agagugaaguaa

SEQ ID NO: 3645 - RNA, 12 nt, Artificial Sequence
  source: /note="Description of Artificial Sequence: Synthetic oligonucleotide"
uagagugaagua

SEQ ID NO: 3646 - RNA, 12 nt, Artificial Sequence
  source: /note="Description of Artificial Sequence: Synthetic oligonucleotide"
cuagagugaagu

SEQ ID NO: 3647 - RNA, 12 nt, Artificial Sequence
  source: /note="Description of Artificial Sequence: Synthetic oligonucleotide"
ccuagagugaag

SEQ ID NO: 3648 - RNA, 12 nt, Artificial Sequence
  source: /note="Description of Artificial Sequence: Synthetic oligonucleotide"
uccuagagugaa

SEQ ID NO: 3649 - RNA, 12 nt, Artificial Sequence
  source: /note="Description of Artificial Sequence: Synthetic oligonucleotide"
uuccuagaguga

SEQ ID NO: 3650 - RNA, 12 nt, Artificial Sequence
  source: /note="Description of Artificial Sequence: Synthetic oligonucleotide"
auuccuagagug

SEQ ID NO: 3651 - RNA, 12 nt, Artificial Sequence
  source: /note="Description of Artificial Sequence: Synthetic oligonucleotide"
acaaaacagcag

SEQ ID NO: 3652 - RNA, 12 nt, Artificial Sequence
  source: /note="Description of Artificial Sequence: Synthetic oligonucleotide"
aacaaaacagca

SEQ ID NO: 3653 - RNA, 12 nt, Artificial Sequence
  source: /note="Description of Artificial Sequence: Synthetic oligonucleotide"
gaacaaaacagc

SEQ ID NO: 3654 - RNA, 12 nt, Artificial Sequence
  source: /note="Description of Artificial Sequence: Synthetic oligonucleotide"
ggaacaaaacag

SEQ ID NO: 3655 - RNA, 12 nt, Artificial Sequence
  source: /note="Description of Artificial Sequence: Synthetic oligonucleotide"
cggaacaaaaca

SEQ ID NO: 3656 - RNA, 12 nt, Artificial Sequence
  source: /note="Description of Artificial Sequence: Synthetic oligonucleotide"
ucggaacaaaac

SEQ ID NO: 3657 - RNA, 12 nt, Artificial Sequence
  source: /note="Description of Artificial Sequence: Synthetic oligonucleotide"
uucggaacaaaa

SEQ ID NO: 3658 - RNA, 12 nt, Artificial Sequence
  source: /note="Description of Artificial Sequence: Synthetic oligonucleotide"
ggcuuguccuca

SEQ ID NO: 3659 - RNA, 12 nt, Artificial Sequence
  source: /note="Description of Artificial Sequence: Synthetic oligonucleotide"
uggcuuguccuc

SEQ ID NO: 3660 - RNA, 12 nt, Artificial Sequence
  source: /note="Description of Artificial Sequence: Synthetic oligonucleotide"
guggcuuguccu

SEQ ID NO: 3661 - RNA, 12 nt, Artificial Sequence
  source: /note="Description of Artificial Sequence: Synthetic oligonucleotide"
uguggcuugucc

SEQ ID NO: 3662 - RNA, 12 nt, Artificial Sequence
  source: /note="Description of Artificial Sequence: Synthetic oligonucleotide"
uuguggcuuguc

SEQ ID NO: 3663 - RNA, 12 nt, Artificial Sequence
  source: /note="Description of Artificial Sequence: Synthetic oligonucleotide"
cuuguggcuugu

SEQ ID NO: 3664 - RNA, 12 nt, Artificial Sequence
  source: /note="Description of Artificial Sequence: Synthetic oligonucleotide"
ucuuguggcuug

SEQ ID NO: 3665 - RNA, 12 nt, Artificial Sequence
  source: /note="Description of Artificial Sequence: Synthetic oligonucleotide"
aucuuguggcuu

SEQ ID NO: 3666 - RNA, 12 nt, Artificial Sequence
  source: /note="Description of Artificial Sequence: Synthetic oligonucleotide"
aaucuuguggcu

SEQ ID NO: 3667 - RNA, 12 nt, Artificial Sequence
  source: /note="Description of Artificial Sequence: Synthetic oligonucleotide"
uaaucuuguggc

SEQ ID NO: 3668 - RNA, 12 nt, Artificial Sequence
  source: /note="Description of Artificial Sequence: Synthetic oligonucleotide"
guaaucuugugg

SEQ ID NO: 3669 - RNA, 12 nt, Artificial Sequence
  source: /note="Description of Artificial Sequence: Synthetic oligonucleotide"
uguaaucuugug

SEQ ID NO: 3670 - RNA, 12 nt, Artificial Sequence
  source: /note="Description of Artificial Sequence: Synthetic oligonucleotide"
uuguaaucuugu

SEQ ID NO: 3671 - RNA, 12 nt, Artificial Sequence
  source: /note="Description of Artificial Sequence: Synthetic oligonucleotide"
uucuuguaaucu

SEQ ID NO: 3672 - RNA, 12 nt, Artificial Sequence
  source: /note="Description of Artificial Sequence: Synthetic oligonucleotide"
agccguuucuug

SEQ ID NO: 3673 - RNA, 12 nt, Artificial Sequence
  source: /note="Description of Artificial Sequence: Synthetic oligonucleotide"
aagccguuucuu

SEQ ID NO: 3674 - RNA, 12 nt, Artificial Sequence
  source: /note="Description of Artificial Sequence: Synthetic oligonucleotide"
gagagagcuggu

SEQ ID NO: 3675 - RNA, 12 nt, Artificial Sequence
  source: /note="Description of Artificial Sequence: Synthetic oligonucleotide"
agagagagcugg

SEQ ID NO: 3676 - RNA, 12 nt, Artificial Sequence
  source: /note="Description of Artificial Sequence: Synthetic oligonucleotide"
aagagagagcug

SEQ ID NO: 3677 - RNA, 12 nt, Artificial Sequence
  source: /note="Description of Artificial Sequence: Synthetic oligonucleotide"
caagccauuggc

SEQ ID NO: 3678 - RNA, 12 nt, Artificial Sequence
  source: /note="Description of Artificial Sequence: Synthetic oligonucleotide"
ccaagccauugg

SEQ ID NO: 3679 - RNA, 12 nt, Artificial Sequence
  source: /note="Description of Artificial Sequence: Synthetic oligonucleotide"
uccaagccauug

SEQ ID NO: 3680 - RNA, 12 nt, Artificial Sequence
  source: /note="Description of Artificial Sequence: Synthetic oligonucleotide"
uuccaagccauu

SEQ ID NO: 3681 - RNA, 12 nt, Artificial Sequence
  source: /note="Description of Artificial Sequence: Synthetic oligonucleotide"
auuccaagccau

SEQ ID NO: 3682 - RNA, 12 nt, Artificial Sequence
  source: /note="Description of Artificial Sequence: Synthetic oligonucleotide"
cauuccaagcca

SEQ ID NO: 3683 - RNA, 12 nt, Artificial Sequence
  source: /note="Description of Artificial Sequence: Synthetic oligonucleotide"
ucauuccaagcc

SEQ ID NO: 3684 - RNA, 12 nt, Artificial Sequence
  source: /note="Description of Artificial Sequence: Synthetic oligonucleotide"
cucauuccaagc

SEQ ID NO: 3685 - RNA, 12 nt, Artificial Sequence
  source: /note="Description of Artificial Sequence: Synthetic oligonucleotide"
ucucauuccaag

SEQ ID NO: 3686 - RNA, 12 nt, Artificial Sequence
  source: /note="Description of Artificial Sequence: Synthetic oligonucleotide"
gucucauuccaa

SEQ ID NO: 3687 - RNA, 12 nt, Artificial Sequence
  source: /note="Description of Artificial Sequence: Synthetic oligonucleotide"
agucucauucca

SEQ ID NO: 3688 - RNA, 12 nt, Artificial Sequence
  source: /note="Description of Artificial Sequence: Synthetic oligonucleotide"
ucucccugggca

SEQ ID NO: 3689 - RNA, 12 nt, Artificial Sequence
  source: /note="Description of Artificial Sequence: Synthetic oligonucleotide"
uucucccugggc

SEQ ID NO: 3690 - RNA, 12 nt, Artificial Sequence
  source: /note="Description of Artificial Sequence: Synthetic oligonucleotide"
ggguucucccug

SEQ ID NO: 3691 - RNA, 12 nt, Artificial Sequence
  source: /note="Description of Artificial Sequence: Synthetic oligonucleotide"
gggguucucccu

SEQ ID NO: 3692 - RNA, 12 nt, Artificial Sequence
  source: /note="Description of Artificial Sequence: Synthetic oligonucleotide"
agggguucuccc

SEQ ID NO: 3693 - RNA, 12 nt, Artificial Sequence
  source: /note="Description of Artificial Sequence: Synthetic oligonucleotide"
aagggguucucc

SEQ ID NO: 3694 - RNA, 12 nt, Artificial Sequence
  source: /note="Description of Artificial Sequence: Synthetic oligonucleotide"
caagggguucuc

SEQ ID NO: 3695 - RNA, 12 nt, Artificial Sequence
  source: /note="Description of Artificial Sequence: Synthetic oligonucleotide"
ccaagggguucu

SEQ ID NO: 3696 - RNA, 12 nt, Artificial Sequence
  source: /note="Description of Artificial Sequence: Synthetic oligonucleotide"
uccaagggguuc

SEQ ID NO: 3697 - RNA, 12 nt, Artificial Sequence
  source: /note="Description of Artificial Sequence: Synthetic oligonucleotide"
auccaagggguu

SEQ ID NO: 3698 - RNA, 12 nt, Artificial Sequence
  source: /note="Description of Artificial Sequence: Synthetic oligonucleotide"
cgauauccaagg

SEQ ID NO: 3699 - RNA, 12 nt, Artificial Sequence
  source: /note="Description of Artificial Sequence: Synthetic oligonucleotide"
gcgauauccaag

SEQ ID NO: 3700 - RNA, 12 nt, Artificial Sequence
  source: /note="Description of Artificial Sequence: Synthetic oligonucleotide"
ggcgauauccaa

SEQ ID NO: 3701 - RNA, 12 nt, Artificial Sequence
  source: /note="Description of Artificial Sequence: Synthetic oligonucleotide"
uggcgauaucca

SEQ ID NO: 3702 - RNA, 12 nt, Artificial Sequence
  source: /note="Description of Artificial Sequence: Synthetic oligonucleotide"
cuggcgauaucc

SEQ ID NO: 3703 - RNA, 12 nt, Artificial Sequence
  source: /note="Description of Artificial Sequence: Synthetic oligonucleotide"
ccuggcgauauc

SEQ ID NO: 3704 - RNA, 12 nt, Artificial Sequence
  source: /note="Description of Artificial Sequence: Synthetic oligonucleotide"
uccuggcgauau

SEQ ID NO: 3705 - RNA, 12 nt, Artificial Sequence
  source: /note="Description of Artificial Sequence: Synthetic oligonucleotide"
auccuggcgaua

SEQ ID NO: 3706 - RNA, 12 nt, Artificial Sequence
  source: /note="Description of Artificial Sequence: Synthetic oligonucleotide"
cauccuggcgau

SEQ ID NO: 3707 - RNA, 12 nt, Artificial Sequence
  source: /note="Description of Artificial Sequence: Synthetic oligonucleotide"
ucauccuggcga

SEQ ID NO: 3708 - RNA, 12 nt, Artificial Sequence
  source: /note="Description of Artificial Sequence: Synthetic oligonucleotide"
aucauccuggcg

SEQ ID NO: 3709 - RNA, 12 nt, Artificial Sequence
  source: /note="Description of Artificial Sequence: Synthetic oligonucleotide"
gaucauccuggc

SEQ ID NO: 3710 - RNA, 12 nt, Artificial Sequence
  source: /note="Description of Artificial Sequence: Synthetic oligonucleotide"
ggaucauccugg

SEQ ID NO: 3711 - RNA, 12 nt, Artificial Sequence
  source: /note="Description of Artificial Sequence: Synthetic oligonucleotide"
aggaucauccug

SEQ ID NO: 3712 - RNA, 12 nt, Artificial Sequence
  source: /note="Description of Artificial Sequence: Synthetic oligonucleotide"
uaggaucauccu

SEQ ID NO: 3713 - RNA, 12 nt, Artificial Sequence
  source: /note="Description of Artificial Sequence: Synthetic oligonucleotide"
cuaggaucaucc

SEQ ID NO: 3714 - RNA, 12 nt, Artificial Sequence
  source: /note="Description of Artificial Sequence: Synthetic oligonucleotide"
gcuaggaucauc

SEQ ID NO: 3715 - RNA, 12 nt, Artificial Sequence
  source: /note="Description of Artificial Sequence: Synthetic oligonucleotide"
agcuaggaucau

SEQ ID NO: 3716 - RNA, 12 nt, Artificial Sequence
  source: /note="Description of Artificial Sequence: Synthetic oligonucleotide"
uagcuaggauca

SEQ ID NO: 3717 - RNA, 12 nt, Artificial Sequence
  source: /note="Description of Artificial Sequence: Synthetic oligonucleotide"
auagcuaggauc

SEQ ID NO: 3718 - RNA, 12 nt, Artificial Sequence
  source: /note="Description of Artificial Sequence: Synthetic oligonucleotide"
gauagcuaggau

SEQ ID NO: 3719 - RNA, 12 nt, Artificial Sequence
  source: /note="Description of Artificial Sequence: Synthetic oligonucleotide"
cgauagcuagga

SEQ ID NO: 3720 - RNA, 12 nt, Artificial Sequence
  source: /note="Description of Artificial Sequence: Synthetic oligonucleotide"
acgauagcuagg

SEQ ID NO: 3721 - RNA, 12 nt, Artificial Sequence
  source: /note="Description of Artificial Sequence: Synthetic oligonucleotide"
aacgauagcuag

SEQ ID NO: 3722 - RNA, 12 nt, Artificial Sequence
  source: /note="Description of Artificial Sequence: Synthetic oligonucleotide"
gaacgauagcua

SEQ ID NO: 3723 - RNA, 12 nt, Artificial Sequence
  source: /note="Description of Artificial Sequence: Synthetic oligonucleotide"
agaacgauagcu

SEQ ID NO: 3724 - RNA, 12 nt, Artificial Sequence
  source: /note="Description of Artificial Sequence: Synthetic oligonucleotide"
aagaacgauagc

SEQ ID NO: 3725 - RNA, 12 nt, Artificial Sequence
  source: /note="Description of Artificial Sequence: Synthetic oligonucleotide"
aaagaacgauag

SEQ ID NO: 3726 - RNA, 12 nt, Artificial Sequence
  source: /note="Description of Artificial Sequence: Synthetic oligonucleotide"
agagugaaaaga

SEQ ID NO: 3727 - RNA, 12 nt, Artificial Sequence
  source: /note="Description of Artificial Sequence: Synthetic oligonucleotide"
cagagugaaaag

SEQ ID NO: 3728 - RNA, 12 nt, Artificial Sequence
  source: /note="Description of Artificial Sequence: Synthetic oligonucleotide"
ccagagugaaaa

SEQ ID NO: 3729 - RNA, 12 nt, Artificial Sequence
  source: /note="Description of Artificial Sequence: Synthetic oligonucleotide"
accagagugaaa

SEQ ID NO: 3730 - RNA, 12 nt, Artificial Sequence
  source: /note="Description of Artificial Sequence: Synthetic oligonucleotide"
caccagagugaa

SEQ ID NO: 3731 - RNA, 12 nt, Artificial Sequence
  source: /note="Description of Artificial Sequence: Synthetic oligonucleotide"
ccaccagaguga

SEQ ID NO: 3732 - RNA, 12 nt, Artificial Sequence
  source: /note="Description of Artificial Sequence: Synthetic oligonucleotide"
uccaccagagug

SEQ ID NO: 3733 - RNA, 12 nt, Artificial Sequence
  source: /note="Description of Artificial Sequence: Synthetic oligonucleotide"
auccaccagagu

SEQ ID NO: 3734 - RNA, 12 nt, Artificial Sequence
  source: /note="Description of Artificial Sequence: Synthetic oligonucleotide"
uauccaccagag

SEQ ID NO: 3735 - RNA, 12 nt, Artificial Sequence
  source: /note="Description of Artificial Sequence: Synthetic oligonucleotide"
ccuggccauauc

SEQ ID NO: 3736 - RNA, 12 nt, Artificial Sequence
  source: /note="Description of Artificial Sequence: Synthetic oligonucleotide"
uccuggccauau

SEQ ID NO: 3737 - RNA, 12 nt, Artificial Sequence
  source: /note="Description of Artificial Sequence: Synthetic oligonucleotide"
auccuggccaua

SEQ ID NO: 3738 - RNA, 12 nt, Artificial Sequence
  source: /note="Description of Artificial Sequence: Synthetic oligonucleotide"
ggcauccuggcc

SEQ ID NO: 3739 - RNA, 12 nt, Artificial Sequence
  source: /note="Description of Artificial Sequence: Synthetic oligonucleotide"
aggcauccuggc

SEQ ID NO: 3740 - RNA, 12 nt, Artificial Sequence
  source: /note="Description of Artificial Sequence: Synthetic oligonucleotide"
aaggcauccugg

SEQ ID NO: 3741 - RNA, 12 nt, Artificial Sequence
  source: /note="Description of Artificial Sequence: Synthetic oligonucleotide"
gguccauaccca

SEQ ID NO: 3742 - RNA, 12 nt, Artificial Sequence
  source: /note="Description of Artificial Sequence: Synthetic oligonucleotide"
ggguccauaccc

SEQ ID NO: 3743 - RNA, 12 nt, Artificial Sequence
  source: /note="Description of Artificial Sequence: Synthetic oligonucleotide"
gggguccauacc

SEQ ID NO: 3744 - RNA, 12 nt, Artificial Sequence
  source: /note="Description of Artificial Sequence: Synthetic oligonucleotide"
ugggguccauac

SEQ ID NO: 3745 - RNA, 12 nt, Artificial Sequence
  source: /note="Description of Artificial Sequence: Synthetic oligonucleotide"
augggguccaua

SEQ ID NO: 3746 - RNA, 12 nt, Artificial Sequence
  source: /note="Description of Artificial Sequence: Synthetic oligonucleotide"
caugggguccau

SEQ ID NO: 3747 - RNA, 12 nt, Artificial Sequence
  source: /note="Description of Artificial Sequence: Synthetic oligonucleotide"
ucauggggucca

SEQ ID NO: 3748 - RNA, 12 nt, Artificial Sequence
  source: /note="Description of Artificial Sequence: Synthetic oligonucleotide"
aucauggggucc

SEQ ID NO: 3749 - RNA, 12 nt, Artificial Sequence
  source: /note="Description of Artificial Sequence: Synthetic oligonucleotide"
caucaugggguc

SEQ ID NO: 3750 - RNA, 12 nt, Artificial Sequence
  source: /note="Description of Artificial Sequence: Synthetic oligonucleotide"
ccaucauggggu

SEQ ID NO: 3751 - RNA, 12 nt, Artificial Sequence
  source: /note="Description of Artificial Sequence: Synthetic oligonucleotide"
uccaucaugggg

SEQ ID NO: 3752 - RNA, 12 nt, Artificial Sequence
  source: /note="Description of Artificial Sequence: Synthetic oligonucleotide"
uuccaucauggg

SEQ ID NO: 3753 - RNA, 12 nt, Artificial Sequence
  source: /note="Description of Artificial Sequence: Synthetic oligonucleotide"
guuccaucaugg

SEQ ID NO: 3754 - RNA, 12 nt, Artificial Sequence
  source: /note="Description of Artificial Sequence: Synthetic oligonucleotide"
uguuccaucaug

SEQ ID NO: 3755 - RNA, 12 nt, Artificial Sequence
  source: /note="Description of Artificial Sequence: Synthetic oligonucleotide"
auguuccaucau

SEQ ID NO: 3756 - RNA, 12 nt, Artificial Sequence
  source: /note="Description of Artificial Sequence: Synthetic oligonucleotide"
gcaccagggugg

SEQ ID NO: 3757 - RNA, 12 nt, Artificial Sequence
  source: /note="Description of Artificial Sequence: Synthetic oligonucleotide"
agcaccagggug

SEQ ID NO: 3758 - RNA, 12 nt, Artificial Sequence
  source: /note="Description of Artificial Sequence: Synthetic oligonucleotide"
cagcaccagggu

SEQ ID NO: 3759 - RNA, 12 nt, Artificial Sequence
  source: /note="Description of Artificial Sequence: Synthetic oligonucleotide"
ucagcaccaggg

SEQ ID NO: 3760 - RNA, 12 nt, Artificial Sequence
  source: /note="Description of Artificial Sequence: Synthetic oligonucleotide"
gucagcaccagg

SEQ ID NO: 3761 - RNA, 12 nt, Artificial Sequence
  source: /note="Description of Artificial Sequence: Synthetic oligonucleotide"
agucagcaccag

SEQ ID NO: 3762 - RNA, 12 nt, Artificial Sequence
  source: /note="Description of Artificial Sequence: Synthetic oligonucleotide"
uagucagcacca

SEQ ID NO: 3763 - RNA, 12 nt, Artificial Sequence
  source: /note="Description of Artificial Sequence: Synthetic oligonucleotide"
auagucagcacc

SEQ ID NO: 3764 - RNA, 12 nt, Artificial Sequence
  source: /note="Description of Artificial Sequence: Synthetic oligonucleotide"
gauagucagcac

SEQ ID NO: 3765 - RNA, 12 nt, Artificial Sequence
  source: /note="Description of Artificial Sequence: Synthetic oligonucleotide"
ggauagucagca

SEQ ID NO: 3766 - RNA, 12 nt, Artificial Sequence
  source: /note="Description of Artificial Sequence: Synthetic oligonucleotide"
uggauagucagc

SEQ ID NO: 3767 - RNA, 12 nt, Artificial Sequence
  source: /note="Description of Artificial Sequence: Synthetic oligonucleotide"
cuggauagucag

SEQ ID NO: 3768 - RNA, 12 nt, Artificial Sequence
  source: /note="Description of Artificial Sequence: Synthetic oligonucleotide"
acuggauaguca

SEQ ID NO: 3769 - RNA, 12 nt, Artificial Sequence
  source: /note="Description of Artificial Sequence: Synthetic oligonucleotide"
aacuggauaguc

SEQ ID NO: 3770 - RNA, 12 nt, Artificial Sequence
  source: /note="Description of Artificial Sequence: Synthetic oligonucleotide"
caacuggauagu

SEQ ID NO: 3771 - RNA, 12 nt, Artificial Sequence
  source: /note="Description of Artificial Sequence: Synthetic oligonucleotide"
ucaacuggauag

SEQ ID NO: 3772 - RNA, 12 nt, Artificial Sequence
  source: /note="Description of Artificial Sequence: Synthetic oligonucleotide"
aucaacuggaua

SEQ ID NO: 3773 - RNA, 12 nt, Artificial Sequence
  source: /note="Description of Artificial Sequence: Synthetic oligonucleotide"
caucaacuggau

SEQ ID NO: 3774 - RNA, 12 nt, Artificial Sequence
  source: /note="Description of Artificial Sequence: Synthetic oligonucleotide"
ccaucaacugga

SEQ ID NO: 3775 - RNA, 12 nt, Artificial Sequence
  source: /note="Description of Artificial Sequence: Synthetic oligonucleotide"
cccaucaacugg

SEQ ID NO: 3776 - RNA, 12 nt, Artificial Sequence
  source: /note="Description of Artificial Sequence: Synthetic oligonucleotide"
gcccaucaacug

SEQ ID NO: 3777 - RNA, 12 nt, Artificial Sequence
  source: /note="Description of Artificial Sequence: Synthetic oligonucleotide"
agcccaucaacu

SEQ ID NO: 3778 - RNA, 12 nt, Artificial Sequence
  source: /note="Description of Artificial Sequence: Synthetic oligonucleotide"
cagcccaucaac

SEQ ID NO: 3779 - RNA, 12 nt, Artificial Sequence
  source: /note="Description of Artificial Sequence: Synthetic oligonucleotide"
augagguccugg

SEQ ID NO: 3780 - RNA, 12 nt, Artificial Sequence
  source: /note="Description of Artificial Sequence: Synthetic oligonucleotide"
caugagguccug

SEQ ID NO: 3781 - RNA, 12 nt, Artificial Sequence
  source: /note="Description of Artificial Sequence: Synthetic oligonucleotide"
ccaugagguccu

SEQ ID NO: 3782 - RNA, 12 nt, Artificial Sequence
  source: /note="Description of Artificial Sequence: Synthetic oligonucleotide"
uccaugaggucc

SEQ ID NO: 3783 - RNA, 12 nt, Artificial Sequence
  source: /note="Description of Artificial Sequence: Synthetic oligonucleotide"
auccaugagguc

SEQ ID NO: 3784 - RNA, 12 nt, Artificial Sequence
  source: /note="Description of Artificial Sequence: Synthetic oligonucleotide"
gccagcugauug

SEQ ID NO: 3785 - RNA, 12 nt, Artificial Sequence
  source: /note="Description of Artificial Sequence: Synthetic oligonucleotide"
ggccagcugauu

SEQ ID NO: 3786 - RNA, 12 nt, Artificial Sequence
  source: /note="Description of Artificial Sequence: Synthetic oligonucleotide"
aggccagcugau

SEQ ID NO: 3787 - RNA, 12 nt, Artificial Sequence
  source: /note="Description of Artificial Sequence: Synthetic oligonucleotide"
caggccagcuga

SEQ ID NO: 3788 - RNA, 12 nt, Artificial Sequence
  source: /note="Description of Artificial Sequence: Synthetic oligonucleotide"
ccaggccagcug

SEQ ID NO: 3789 - RNA, 12 nt, Artificial Sequence
  source: /note="Description of Artificial Sequence: Synthetic oligonucleotide"
accaggccagcu

SEQ ID NO: 3790 - RNA, 12 nt, Artificial Sequence
  source: /note="Description of Artificial Sequence: Synthetic oligonucleotide"
aaccaggccagc

SEQ ID NO: 3791 - RNA, 12 nt, Artificial Sequence
  source: /note="Description of Artificial Sequence: Synthetic oligonucleotide"
aaaccaggccag

SEQ ID NO: 3792 - RNA, 12 nt, Artificial Sequence
  source: /note="Description of Artificial Sequence: Synthetic oligonucleotide"
caaaccaggcca

SEQ ID NO: 3793 - RNA, 12 nt, Artificial Sequence
  source: /note="Description of Artificial Sequence: Synthetic oligonucleotide"
ucaaaccaggcc

SEQ ID NO: 3794 - RNA, 12 nt, Artificial Sequence
  source: /note="Description of Artificial Sequence: Synthetic oligonucleotide"
aucaaaccaggc

SEQ ID NO: 3795 - RNA, 12 nt, Artificial Sequence
  source: /note="Description of Artificial Sequence: Synthetic oligonucleotide"
uaucaaaccagg

SEQ ID NO: 3796 - RNA, 12 nt, Artificial Sequence
  source: /note="Description of Artificial Sequence: Synthetic oligonucleotide"
guaucaaaccag

SEQ ID NO: 3797 - RNA, 12 nt, Artificial Sequence
  source: /note="Description of Artificial Sequence: Synthetic oligonucleotide"
aguaucaaacca

SEQ ID NO: 3798 - RNA, 12 nt, Artificial Sequence
  source: /note="Description of Artificial Sequence: Synthetic oligonucleotide"
caguaucaaacc

SEQ ID NO: 3799 - RNA, 12 nt, Artificial Sequence
  source: /note="Description of Artificial Sequence: Synthetic oligonucleotide"
ucaguaucaaac

SEQ ID NO: 3800 - RNA, 12 nt, Artificial Sequence
  source: /note="Description of Artificial Sequence: Synthetic oligonucleotide"
gucaguaucaaa

SEQ ID NO: 3801 - RNA, 12 nt, Artificial Sequence
  source: /note="Description of Artificial Sequence: Synthetic oligonucleotide"
ggucaguaucaa

SEQ ID NO: 3802 - RNA, 12 nt, Artificial Sequence
  source: /note="Description of Artificial Sequence: Synthetic oligonucleotide"
aggucaguauca

SEQ ID NO: 3803 - RNA, 12 nt, Artificial Sequence
  source: /note="Description of Artificial Sequence: Synthetic oligonucleotide"
caggucaguauc

SEQ ID NO: 3804 - RNA, 12 nt, Artificial Sequence
  source: /note="Description of Artificial Sequence: Synthetic oligonucleotide"
acaggucaguau

SEQ ID NO: 3805 - RNA, 12 nt, Artificial Sequence
  source: /note="Description of Artificial Sequence: Synthetic oligonucleotide"
uacaggucagua

SEQ ID NO: 3806 - RNA, 12 nt, Artificial Sequence
  source: /note="Description of Artificial Sequence: Synthetic oligonucleotide"
uuacaggucagu

SEQ ID NO: 3807 - RNA, 12 nt, Artificial Sequence
  source: /note="Description of Artificial Sequence: Synthetic oligonucleotide"
uuuacaggucag

SEQ ID NO: 3808 - RNA, 12 nt, Artificial Sequence
  source: /note="Description of Artificial Sequence: Synthetic oligonucleotide"
auuuacagguca

SEQ ID NO: 3809 - RNA, 12 nt, Artificial Sequence
  source: /note="Description of Artificial Sequence: Synthetic oligonucleotide"
gauuuacagguc

SEQ ID NO: 3810 - RNA, 12 nt, Artificial Sequence
  source: /note="Description of Artificial Sequence: Synthetic oligonucleotide"
ugauuuacaggu

SEQ ID NO: 3811 - RNA, 12 nt, Artificial Sequence
  source: /note="Description of Artificial Sequence: Synthetic oligonucleotide"
augauuuacagg

SEQ ID NO: 3812 - RNA, 12 nt, Artificial Sequence
  source: /note="Description of Artificial Sequence: Synthetic oligonucleotide"
gaugauuuacag

SEQ ID NO: 3813 - RNA, 12 nt, Artificial Sequence
  source: /note="Description of Artificial Sequence: Synthetic oligonucleotide"
ggaugauuuaca

SEQ ID NO: 3814 - RNA, 12 nt, Artificial Sequence
  source: /note="Description of Artificial Sequence: Synthetic oligonucleotide"
aggaugauuuac

SEQ ID NO: 3815 - RNA, 12 nt, Artificial Sequence
  source: /note="Description of Artificial Sequence: Synthetic oligonucleotide"
aaggaugauuua

SEQ ID NO: 3816 - RNA, 12 nt, Artificial Sequence
  source: /note="Description of Artificial Sequence: Synthetic oligonucleotide"
aaaggaugauuu

SEQ ID NO: 3817 - RNA, 12 nt, Artificial Sequence
  source: /note="Description of Artificial Sequence: Synthetic oligonucleotide"
uuguauuguuac

SEQ ID NO: 3818 - RNA, 12 nt, Artificial Sequence
  source: /note="Description of Artificial Sequence: Synthetic oligonucleotide"
uuuguauuguua

SEQ ID NO: 3819 - RNA, 12 nt, Artificial Sequence
  source: /note="Description of Artificial Sequence: Synthetic oligonucleotide"
auuuguauuguu

SEQ ID NO: 3820 - RNA, 12 nt, Artificial Sequence
  source: /note="Description of Artificial Sequence: Synthetic oligonucleotide"
cauuuguauugu

SEQ ID NO: 3821 - RNA, 12 nt, Artificial Sequence
  source: /note="Description of Artificial Sequence: Synthetic oligonucleotide"
ccauuuguauug

SEQ ID NO: 3822 - RNA, 12 nt, Artificial Sequence
  source: /note="Description of Artificial Sequence: Synthetic oligonucleotide"
uccauuuguauu

SEQ ID NO: 3823 - RNA, 12 nt, Artificial Sequence
  source: /note="Description of Artificial Sequence: Synthetic oligonucleotide"
auccauuuguau

SEQ ID NO: 3824 - RNA, 12 nt, Artificial Sequence
  source: /note="Description of Artificial Sequence: Synthetic oligonucleotide"
aauccauuugua

SEQ ID NO: 3825 - RNA, 12 nt, Artificial Sequence
  source: /note="Description of Artificial Sequence: Synthetic oligonucleotide"
aaauccauuugu

SEQ ID NO: 3826 - RNA, 12 nt, Artificial Sequence
  source: /note="Description of Artificial Sequence: Synthetic oligonucleotide"
aaaauccauuug

SEQ ID NO: 3827 - RNA, 12 nt, Artificial Sequence
  source: /note="Description of Artificial Sequence: Synthetic oligonucleotide"
caaaauccauuu

SEQ ID NO: 3828 - RNA, 12 nt, Artificial Sequence
  source: /note="Description of Artificial Sequence: Synthetic oligonucleotide"
gagucacuccca

SEQ ID NO: 3829 - RNA, 12 nt, Artificial Sequence
  source: /note="Description of Artificial Sequence: Synthetic oligonucleotide"
ugagucacuccc

SEQ ID NO: 3830 - RNA, 12 nt, Artificial Sequence
  source: /note="Description of Artificial Sequence: Synthetic oligonucleotide"
uugagucacucc

SEQ ID NO: 3831 - RNA, 12 nt, Artificial Sequence
  source: /note="Description of Artificial Sequence: Synthetic oligonucleotide"
cuugagucacuc

SEQ ID NO: 3832 - RNA, 12 nt, Artificial Sequence
  source: /note="Description of Artificial Sequence: Synthetic oligonucleotide"
ucuugagucacu

SEQ ID NO: 3833 - RNA, 12 nt, Artificial Sequence
  source: /note="Description of Artificial Sequence: Synthetic oligonucleotide"
uucuugagucac

SEQ ID NO: 3834 - RNA, 12 nt, Artificial Sequence
  source: /note="Description of Artificial Sequence: Synthetic oligonucleotide"
cuucuugaguca

SEQ ID NO: 3835 - RNA, 12 nt, Artificial Sequence
  source: /note="Description of Artificial Sequence: Synthetic oligonucleotide"
cauucuucacuu

SEQ ID NO: 3836 - RNA, 12 nt, Artificial Sequence
  source: /note="Description of Artificial Sequence: Synthetic oligonucleotide"
gcauucuucacu

SEQ ID NO: 3837 - RNA, 12 nt, Artificial Sequence
  source: /note="Description of Artificial Sequence: Synthetic oligonucleotide"
ugcauucuucac

SEQ ID NO: 3838 - RNA, 12 nt, Artificial Sequence
  source: /note="Description of Artificial Sequence: Synthetic oligonucleotide"
gugcauucuuca

SEQ ID NO: 3839 - RNA, 12 nt, Artificial Sequence
  source: /note="Description of Artificial Sequence: Synthetic oligonucleotide"
ugugcauucuuc

SEQ ID NO: 3840 - RNA, 12 nt, Artificial Sequence
  source: /note="Description of Artificial Sequence: Synthetic oligonucleotide"
uugugcauucuu

SEQ ID NO: 3841 - RNA, 12 nt, Artificial Sequence
  source: /note="Description of Artificial Sequence: Synthetic oligonucleotide"
cuugugcauucu

SEQ ID NO: 3842 - RNA, 12 nt, Artificial Sequence
  source: /note="Description of Artificial Sequence: Synthetic oligonucleotide"
ucuugugcauuc

SEQ ID NO: 3843 - RNA, 12 nt, Artificial Sequence
  source: /note="Description of Artificial Sequence: Synthetic oligonucleotide"
cuugugauccau

SEQ ID NO: 3844 - RNA, 12 nt, Artificial Sequence
  source: /note="Description of Artificial Sequence: Synthetic oligonucleotide"
ucuugugaucca

SEQ ID NO: 3845 - RNA, 12 nt, Artificial Sequence
  source: /note="Description of Artificial Sequence: Synthetic oligonucleotide"
aucuugugaucc

SEQ ID NO: 3846 - RNA, 12 nt, Artificial Sequence
  source: /note="Description of Artificial Sequence: Synthetic oligonucleotide"
caucuugugauc

SEQ ID NO: 3847 - RNA, 12 nt, Artificial Sequence
  source: /note="Description of Artificial Sequence: Synthetic oligonucleotide"
ccaucuugugau

SEQ ID NO: 3848 - RNA, 12 nt, Artificial Sequence
  source: /note="Description of Artificial Sequence: Synthetic oligonucleotide"
uccaucuuguga

SEQ ID NO: 3849 - RNA, 12 nt, Artificial Sequence
  source: /note="Description of Artificial Sequence: Synthetic oligonucleotide"
uuccaucuugug

SEQ ID NO: 3850 - RNA, 12 nt, Artificial Sequence
  source: /note="Description of Artificial Sequence: Synthetic oligonucleotide"
auuccaucuugu

SEQ ID NO: 3851 - RNA, 12 nt, Artificial Sequence
  source: /note="Description of Artificial Sequence: Synthetic oligonucleotide"
aauuccaucuug

SEQ ID NO: 3852 - RNA, 12 nt, Artificial Sequence
  source: /note="Description of Artificial Sequence: Synthetic oligonucleotide"
aaauuccaucuu

SEQ ID NO: 3853 - RNA, 12 nt, Artificial Sequence
  source: /note="Description of Artificial Sequence: Synthetic oligonucleotide"
uaaauuccaucu

SEQ ID NO: 3854 - RNA, 12 nt, Artificial Sequence
  source: /note="Description of Artificial Sequence: Synthetic oligonucleotide"
auaaauuccauc

SEQ ID NO: 3855 - RNA, 12 nt, Artificial Sequence
  source: /note="Description of Artificial Sequence: Synthetic oligonucleotide"
gauaaauuccau

SEQ ID NO: 3856 - RNA, 12 nt, Artificial Sequence
  source: /note="Description of Artificial Sequence: Synthetic oligonucleotide"
ugauaaauucca

SEQ ID NO: 3857 - RNA, 12 nt, Artificial Sequence
  source: /note="Description of Artificial Sequence: Synthetic oligonucleotide"
uugauaaauucc

SEQ ID NO: 3858 - RNA, 12 nt, Artificial Sequence
  source: /note="Description of Artificial Sequence: Synthetic oligonucleotide"
uuugauaaauuc

SEQ ID NO: 3859 - RNA, 12 nt, Artificial Sequence
  source: /note="Description of Artificial Sequence: Synthetic oligonucleotide"
guuugauaaauu

SEQ ID NO: 3860 - RNA, 12 nt, Artificial Sequence
  source: /note="Description of Artificial Sequence: Synthetic oligonucleotide"
gguuugauaaau

SEQ ID NO: 3861 - RNA, 12 nt, Artificial Sequence
  source: /note="Description of Artificial Sequence: Synthetic oligonucleotide"
ggguuugauaaa

SEQ ID NO: 3862 - RNA, 12 nt, Artificial Sequence
  source: /note="Description of Artificial Sequence: Synthetic oligonucleotide"
aggguuugauaa

SEQ ID NO: 3863 - RNA, 12 nt, Artificial Sequence
  source: /note="Description of Artificial Sequence: Synthetic oligonucleotide"
uaggguuugaua

SEQ ID NO: 3864 - RNA, 12 nt, Artificial Sequence
  source: /note="Description of Artificial Sequence: Synthetic oligonucleotide"
cuaggguuugau

SEQ ID NO: 3865 - RNA, 12 nt, Artificial Sequence
  source: /note="Description of Artificial Sequence: Synthetic oligonucleotide"
gcuaggguuuga

SEQ ID NO: 3866 - RNA, 12 nt, Artificial Sequence
  source: /note="Description of Artificial Sequence: Synthetic oligonucleotide"
ggcuaggguuug

SEQ ID NO: 3867 - RNA, 12 nt, Artificial Sequence
  source: /note="Description of Artificial Sequence: Synthetic oligonucleotide"
aggcuaggguuu

SEQ ID NO: 3868 - RNA, 12 nt, Artificial Sequence
  source: /note="Description of Artificial Sequence: Synthetic oligonucleotide"
aaggcuaggguu

SEQ ID NO: 3869 - RNA, 12 nt, Artificial Sequence
  source: /note="Description of Artificial Sequence: Synthetic oligonucleotide"
caaggcuagggu

SEQ ID NO: 3870 - RNA, 12 nt, Artificial Sequence
  source: /note="Description of Artificial Sequence: Synthetic oligonucleotide"
gcaaggcuaggg

SEQ ID NO: 3871 - RNA, 12 nt, Artificial Sequence
  source: /note="Description of Artificial Sequence: Synthetic oligonucleotide"
agcaaggcuagg

SEQ ID NO: 3872 - RNA, 12 nt, Artificial Sequence
  source: /note="Description of Artificial Sequence: Synthetic oligonucleotide"
aagcaaggcuag

SEQ ID NO: 3873 - RNA, 12 nt, Artificial Sequence
  source: /note="Description of Artificial Sequence: Synthetic oligonucleotide"
caagcaaggcua

SEQ ID NO: 3874 - RNA, 12 nt, Artificial Sequence
  source: /note="Description of Artificial Sequence: Synthetic oligonucleotide"
acaagcaaggcu

SEQ ID NO: 3875 - RNA, 12 nt, Artificial Sequence
  source: /note="Description of Artificial Sequence: Synthetic oligonucleotide"
aacaagcaaggc

SEQ ID NO: 3876 - RNA, 12 nt, Artificial Sequence
  source: /note="Description of Artificial Sequence: Synthetic oligonucleotide"
uaacaagcaagg

SEQ ID NO: 3877 - RNA, 12 nt, Artificial Sequence
  source: /note="Description of Artificial Sequence: Synthetic oligonucleotide"
uuaacaagcaag

SEQ ID NO: 3878 - RNA, 12 nt, Artificial Sequence
  source: /note="Description of Artificial Sequence: Synthetic oligonucleotide"
uuuaacaagcaa

SEQ ID NO: 3879 - RNA, 12 nt, Artificial Sequence
  source: /note="Description of Artificial Sequence: Synthetic oligonucleotide"
auuuaacaagca

SEQ ID NO: 3880 - RNA, 12 nt, Artificial Sequence
  source: /note="Description of Artificial Sequence: Synthetic oligonucleotide"
aauuuaacaagc

SEQ ID NO: 3881 - RNA, 12 nt, Artificial Sequence
  source: /note="Description of Artificial Sequence: Synthetic oligonucleotide"
uuacagauauuc

SEQ ID NO: 3882 - RNA, 12 nt, Artificial Sequence
  source: /note="Description of Artificial Sequence: Synthetic oligonucleotide"
auuacagauauu

SEQ ID NO: 3883 - RNA, 12 nt, Artificial Sequence
  source: /note="Description of Artificial Sequence: Synthetic oligonucleotide"
cauuacagauau

SEQ ID NO: 3884 - RNA, 12 nt, Artificial Sequence
  source: /note="Description of Artificial Sequence: Synthetic oligonucleotide"
ccauuacagaua

SEQ ID NO: 3885 - RNA, 12 nt, Artificial Sequence
  source: /note="Description of Artificial Sequence: Synthetic oligonucleotide"
accauuacagau

SEQ ID NO: 3886 - RNA, 12 nt, Artificial Sequence
  source: /note="Description of Artificial Sequence: Synthetic oligonucleotide"
uaccauuacaga

SEQ ID NO: 3887 - RNA, 12 nt, Artificial Sequence
  source: /note="Description of Artificial Sequence: Synthetic oligonucleotide"
guaccauuacag

SEQ ID NO: 3888 - RNA, 12 nt, Artificial Sequence
  source: /note="Description of Artificial Sequence: Synthetic oligonucleotide"
aguaccauuaca

SEQ ID NO: 3889 - RNA, 12 nt, Artificial Sequence
  source: /note="Description of Artificial Sequence: Synthetic oligonucleotide"
caguaccauuac

SEQ ID NO: 3890 - RNA, 12 nt, Artificial Sequence
  source: /note="Description of Artificial Sequence: Synthetic oligonucleotide"
gagagacuuaaa

SEQ ID NO: 3891 - RNA, 12 nt, Artificial Sequence
  source: /note="Description of Artificial Sequence: Synthetic oligonucleotide"
cgagagacuuaa

SEQ ID NO: 3892 - RNA, 12 nt, Artificial Sequence
  source: /note="Description of Artificial Sequence: Synthetic oligonucleotide"
acgagagacuua

SEQ ID NO: 3893 - RNA, 12 nt, Artificial Sequence
  source: /note="Description of Artificial Sequence: Synthetic oligonucleotide"
uacgagagacuu

SEQ ID NO: 3894 - RNA, 12 nt, Artificial Sequence
  source: /note="Description of Artificial Sequence: Synthetic oligonucleotide"
cuacgagagacu

SEQ ID NO: 3895 - RNA, 12 nt, Artificial Sequence
  source: /note="Description of Artificial Sequence: Synthetic oligonucleotide"
acuacgagagac

SEQ ID NO: 3896 - RNA, 12 nt, Artificial Sequence
  source: /note="Description of Artificial Sequence: Synthetic oligonucleotide"
cacuacgagaga

SEQ ID NO: 3897 - RNA, 12 nt, Artificial Sequence
  source: /note="Description of Artificial Sequence: Synthetic oligonucleotide"
acacuacgagag

SEQ ID NO: 3898 - RNA, 12 nt, Artificial Sequence
  source: /note="Description of Artificial Sequence: Synthetic oligonucleotide"
aacacuacgaga

SEQ ID NO: 3899 - RNA, 12 nt, Artificial Sequence
  source: /note="Description of Artificial Sequence: Synthetic oligonucleotide"
uaacacuacgag

SEQ ID NO: 3900 - RNA, 12 nt, Artificial Sequence
  source: /note="Description of Artificial Sequence: Synthetic oligonucleotide"
uuaacacuacga

SEQ ID NO: 3901 - RNA, 12 nt, Artificial Sequence
  source: /note="Description of Artificial Sequence: Synthetic oligonucleotide"
cuuaacacuacg

SEQ ID NO: 3902 - RNA, 12 nt, Artificial Sequence
  source: /note="Description of Artificial Sequence: Synthetic oligonucleotide"
acuuaacacuac

SEQ ID NO: 3903 - RNA, 12 nt, Artificial Sequence
  source: /note="Description of Artificial Sequence: Synthetic oligonucleotide"
aacuuaacacua

SEQ ID NO: 3904 - RNA, 12 nt, Artificial Sequence
  source: /note="Description of Artificial Sequence: Synthetic oligonucleotide"
uaacuuaacacu

SEQ ID NO: 3905 - RNA, 12 nt, Artificial Sequence
  source: /note="Description of Artificial Sequence: Synthetic oligonucleotide"
auaacuuaacac

SEQ ID NO: 3906 - RNA, 12 nt, Artificial Sequence
  source: /note="Description of Artificial Sequence: Synthetic oligonucleotide"
uauaacuuaaca

SEQ ID NO: 3907 - RNA, 12 nt, Artificial Sequence
  source: /note="Description of Artificial Sequence: Synthetic oligonucleotide"
cuauaacuuaac

SEQ ID NO: 3908 - RNA, 12 nt, Artificial Sequence
  source: /note="Description of Artificial Sequence: Synthetic oligonucleotide"
acuauaacuuaa

SEQ ID NO: 3909 - RNA, 12 nt, Artificial Sequence
  source: /note="Description of Artificial Sequence: Synthetic oligonucleotide"
cacuauaacuua

SEQ ID NO: 3910 - RNA, 12 nt, Artificial Sequence
  source: /note="Description of Artificial Sequence: Synthetic oligonucleotide"
ucacuauaacuu

SEQ ID NO: 3911 - RNA, 12 nt, Artificial Sequence
  source: /note="Description of Artificial Sequence: Synthetic oligonucleotide"
uucacuauaacu

SEQ ID NO: 3912 - RNA, 12 nt, Artificial Sequence
  source: /note="Description of Artificial Sequence: Synthetic oligonucleotide"
gaaauugcugua

SEQ ID NO: 3913 - RNA, 12 nt, Artificial Sequence
  source: /note="Description of Artificial Sequence: Synthetic oligonucleotide"
agaaauugcugu

SEQ ID NO: 3914 - RNA, 12 nt, Artificial Sequence
  source: /note="Description of Artificial Sequence: Synthetic oligonucleotide"
uagaaauugcug

SEQ ID NO: 3915 - RNA, 12 nt, Artificial Sequence
  source: /note="Description of Artificial Sequence: Synthetic oligonucleotide"
uuagaaauugcu

SEQ ID NO: 3916 - RNA, 12 nt, Artificial Sequence
  source: /note="Description of Artificial Sequence: Synthetic oligonucleotide"
auuagaaauugc

SEQ ID NO: 3917 - RNA, 12 nt, Artificial Sequence
  source: /note="Description of Artificial Sequence: Synthetic oligonucleotide"
aauuagaaauug

SEQ ID NO: 3918 - RNA, 12 nt, Artificial Sequence
  source: /note="Description of Artificial Sequence: Synthetic oligonucleotide"
aaauuagaaauu

SEQ ID NO: 3919 - RNA, 12 nt, Artificial Sequence
  source: /note="Description of Artificial Sequence: Synthetic oligonucleotide"
ucuacaccauua

SEQ ID NO: 3920 - RNA, 12 nt, Artificial Sequence
  source: /note="Description of Artificial Sequence: Synthetic oligonucleotide"
uucuacaccauu

SEQ ID NO: 3921 - RNA, 12 nt, Artificial Sequence
  source: /note="Description of Artificial Sequence: Synthetic oligonucleotide"
guucuacaccau

SEQ ID NO: 3922 - RNA, 12 nt, Artificial Sequence
  source: /note="Description of Artificial Sequence: Synthetic oligonucleotide"
uguucuacacca

SEQ ID NO: 3923 - RNA, 12 nt, Artificial Sequence
  source: /note="Description of Artificial Sequence: Synthetic oligonucleotide"
guguucuacacc

SEQ ID NO: 3924 - RNA, 12 nt, Artificial Sequence
  source: /note="Description of Artificial Sequence: Synthetic oligonucleotide"
aguguucuacac

SEQ ID NO: 3925 - RNA, 12 nt, Artificial Sequence
  source: /note="Description of Artificial Sequence: Synthetic oligonucleotide"
uaguguucuaca

SEQ ID NO: 3926 - RNA, 12 nt, Artificial Sequence
  source: /note="Description of Artificial Sequence: Synthetic oligonucleotide"
uuaguguucuac

SEQ ID NO: 3927 - RNA, 12 nt, Artificial Sequence
  source: /note="Description of Artificial Sequence: Synthetic oligonucleotide"
auuaguguucua

SEQ ID NO: 3928 - RNA, 12 nt, Artificial Sequence
  source: /note="Description of Artificial Sequence: Synthetic oligonucleotide"
aauuaguguucu

SEQ ID NO: 3929 - RNA, 12 nt, Artificial Sequence
  source: /note="Description of Artificial Sequence: Synthetic oligonucleotide"
gaauuaguguuc

SEQ ID NO: 3930 - RNA, 12 nt, Artificial Sequence
  source: /note="Description of Artificial Sequence: Synthetic oligonucleotide"
ugaauuaguguu

SEQ ID NO: 3931 - RNA, 12 nt, Artificial Sequence
  source: /note="Description of Artificial Sequence: Synthetic oligonucleotide"
augaauuagugu

SEQ ID NO: 3932 - RNA, 12 nt, Artificial Sequence
  source: /note="Description of Artificial Sequence: Synthetic oligonucleotide"
uaugaauuagug

SEQ ID NO: 3933 - RNA, 12 nt, Artificial Sequence
  source: /note="Description of Artificial Sequence: Synthetic oligonucleotide"
uuaugaauuagu

SEQ ID NO: 3934 - RNA, 12 nt, Artificial Sequence
  source: /note="Description of Artificial Sequence: Synthetic oligonucleotide"
auuaugaauuag

SEQ ID NO: 3935 - RNA, 12 nt, Artificial Sequence
  source: /note="Description of Artificial Sequence: Synthetic oligonucleotide"
gauuaugaauua

SEQ ID NO: 3936 - RNA, 12 nt, Artificial Sequence
  source: /note="Description of Artificial Sequence: Synthetic oligonucleotide"
ugauuaugaauu

SEQ ID NO: 3937 - RNA, 12 nt, Artificial Sequence
  source: /note="Description of Artificial Sequence: Synthetic oligonucleotide"
gugauuaugaau

SEQ ID NO: 3938 - RNA, 12 nt, Artificial Sequence
  source: /note="Description of Artificial Sequence: Synthetic oligonucleotide"
agugauuaugaa

SEQ ID NO: 3939 - RNA, 12 nt, Artificial Sequence
  source: /note="Description of Artificial Sequence: Synthetic oligonucleotide"
gagugauuauga

SEQ ID NO: 3940 - RNA, 12 nt, Artificial Sequence
  source: /note="Description of Artificial Sequence: Synthetic oligonucleotide"
agagugauuaug

SEQ ID NO: 3941 - RNA, 12 nt, Artificial Sequence
  source: /note="Description of Artificial Sequence: Synthetic oligonucleotide"
uagagugauuau

SEQ ID NO: 3942 - RNA, 12 nt, Artificial Sequence
  source: /note="Description of Artificial Sequence: Synthetic oligonucleotide"
uuagagugauua

SEQ ID NO: 3943 - RNA, 12 nt, Artificial Sequence
  source: /note="Description of Artificial Sequence: Synthetic oligonucleotide"
cagauuacaauu

SEQ ID NO: 3944 - RNA, 12 nt, Artificial Sequence
  source: /note="Description of Artificial Sequence: Synthetic oligonucleotide"
ucagauuacaau

SEQ ID NO: 3945 - RNA, 12 nt, Artificial Sequence
  source: /note="Description of Artificial Sequence: Synthetic oligonucleotide"
uucagauuacaa

SEQ ID NO: 3946 - RNA, 12 nt, Artificial Sequence
  source: /note="Description of Artificial Sequence: Synthetic oligonucleotide"
auucagauuaca

SEQ ID NO: 3947 - RNA, 12 nt, Artificial Sequence
  source: /note="Description of Artificial Sequence: Synthetic oligonucleotide"
uauucagauuac

SEQ ID NO: 3948 - RNA, 12 nt, Artificial Sequence
  source: /note="Description of Artificial Sequence: Synthetic oligonucleotide"
uuauucagauua

SEQ ID NO: 3949 - RNA, 12 nt, Artificial Sequence
  source: /note="Description of Artificial Sequence: Synthetic oligonucleotide"
uuuauucagauu

SEQ ID NO: 3950 - RNA, 12 nt, Artificial Sequence
  source: /note="Description of Artificial Sequence: Synthetic oligonucleotide"
cuuuauucagau

SEQ ID NO: 3951 - RNA, 12 nt, Artificial Sequence
  source: /note="Description of Artificial Sequence: Synthetic oligonucleotide"
acuuuauucaga

SEQ ID NO: 3952 - RNA, 12 nt, Artificial Sequence
  source: /note="Description of Artificial Sequence: Synthetic oligonucleotide"
cacuuuauucag

SEQ ID NO: 3953 - RNA, 12 nt, Artificial Sequence
  source: /note="Description of Artificial Sequence: Synthetic oligonucleotide"
uauuuuauacaa

SEQ ID NO: 3954 - RNA, 12 nt, Artificial Sequence
  source: /note="Description of Artificial Sequence: Synthetic oligonucleotide"
cuauuuuauaca

SEQ ID NO: 3955 - RNA, 12 nt, Artificial Sequence
  source: /note="Description of Artificial Sequence: Synthetic oligonucleotide"
ucuauuuuauac

SEQ ID NO: 3956 - RNA, 12 nt, Artificial Sequence
  source: /note="Description of Artificial Sequence: Synthetic oligonucleotide"
gucuauuuuaua

SEQ ID NO: 3957 - RNA, 12 nt, Artificial Sequence
  source: /note="Description of Artificial Sequence: Synthetic oligonucleotide"
ugucuauuuuau

SEQ ID NO: 3958 - RNA, 12 nt, Artificial Sequence
  source: /note="Description of Artificial Sequence: Synthetic oligonucleotide"
uugucuauuuua

SEQ ID NO: 3959 - RNA, 12 nt, Artificial Sequence
  source: /note="Description of Artificial Sequence: Synthetic oligonucleotide"
uuugucuauuuu

SEQ ID NO: 3960 - RNA, 12 nt, Artificial Sequence
  source: /note="Description of Artificial Sequence: Synthetic oligonucleotide"
auuugucuauuu

SEQ ID NO: 3961 - RNA, 12 nt, Artificial Sequence
  source: /note="Description of Artificial Sequence: Synthetic oligonucleotide"
uauuugucuauu

SEQ ID NO: 3962 - RNA, 12 nt, Artificial Sequence
  source: /note="Description of Artificial Sequence: Synthetic oligonucleotide"
cuauuugucuau

SEQ ID NO: 3963 - RNA, 12 nt, Artificial Sequence
  source: /note="Description of Artificial Sequence: Synthetic oligonucleotide"
ucuauuugucua

SEQ ID NO: 3964 - RNA, 12 nt, Artificial Sequence
  source: /note="Description of Artificial Sequence: Synthetic oligonucleotide"
uucuauuugucu

SEQ ID NO: 3965 - RNA, 12 nt, Artificial Sequence
  source: /note="Description of Artificial Sequence: Synthetic oligonucleotide"
uuucuauuuguc

SEQ ID NO: 3966 - RNA, 12 nt, Artificial Sequence
  source: /note="Description of Artificial Sequence: Synthetic oligonucleotide"
uuuucuauuugu

SEQ ID NO: 3967 - RNA, 12 nt, Artificial Sequence
  source: /note="Description of Artificial Sequence: Synthetic oligonucleotide"
auuuucuauuug

SEQ ID NO: 3968 - RNA, 12 nt, Artificial Sequence
  source: /note="Description of Artificial Sequence: Synthetic oligonucleotide"
cauuuucuauuu

SEQ ID NO: 3969 - RNA, 12 nt, Artificial Sequence
  source: /note="Description of Artificial Sequence: Synthetic oligonucleotide"
ccauuuucuauu

SEQ ID NO: 3970 - RNA, 12 nt, Artificial Sequence
  source: /note="Description of Artificial Sequence: Synthetic oligonucleotide"
accauuuucuau

SEQ ID NO: 3971 - RNA, 12 nt, Artificial Sequence
  source: /note="Description of Artificial Sequence: Synthetic oligonucleotide"
gaccauuuucua

SEQ ID NO: 3972 - RNA, 12 nt, Artificial Sequence
  source: /note="Description of Artificial Sequence: Synthetic oligonucleotide"
ggaccauuuucu

SEQ ID NO: 3973 - RNA, 12 nt, Artificial Sequence
  source: /note="Description of Artificial Sequence: Synthetic oligonucleotide"
uggaccauuuuc

SEQ ID NO: 3974 - RNA, 12 nt, Artificial Sequence
  source: /note="Description of Artificial Sequence: Synthetic oligonucleotide"
uuggaccauuuu

SEQ ID NO: 3975 - RNA, 12 nt, Artificial Sequence
  source: /note="Description of Artificial Sequence: Synthetic oligonucleotide"
auuggaccauuu

SEQ ID NO: 3976 - RNA, 12 nt, Artificial Sequence
  source: /note="Description of Artificial Sequence: Synthetic oligonucleotide"
aauuggaccauu

SEQ ID NO: 3977 - RNA, 12 nt, Artificial Sequence
  source: /note="Description of Artificial Sequence: Synthetic oligonucleotide"
uaauuggaccau

SEQ ID NO: 3978 - RNA, 12 nt, Artificial Sequence
  source: /note="Description of Artificial Sequence: Synthetic oligonucleotide"
cuaauuggacca

SEQ ID NO: 3979 - RNA, 12 nt, Artificial Sequence
  source: /note="Description of Artificial Sequence: Synthetic oligonucleotide"
uauuuuaagcau

SEQ ID NO: 3980 - RNA, 12 nt, Artificial Sequence
  source: /note="Description of Artificial Sequence: Synthetic oligonucleotide"
uuauuuuaagca

SEQ ID NO: 3981 - RNA, 12 nt, Artificial Sequence
  source: /note="Description of Artificial Sequence: Synthetic oligonucleotide"
cuuauuuuaagc

SEQ ID NO: 3982 - RNA, 12 nt, Artificial Sequence
  source: /note="Description of Artificial Sequence: Synthetic oligonucleotide"
gcuuauuuuaag

SEQ ID NO: 3983 - RNA, 12 nt, Artificial Sequence
  source: /note="Description of Artificial Sequence: Synthetic oligonucleotide"
ugcuuauuuuaa

SEQ ID NO: 3984 - RNA, 12 nt, Artificial Sequence
  source: /note="Description of Artificial Sequence: Synthetic oligonucleotide"
cugcuuauuuua

SEQ ID NO: 3985 - RNA, 12 nt, Artificial Sequence
  source: /note="Description of Artificial Sequence: Synthetic oligonucleotide"
ccugcuuauuuu

SEQ ID NO: 3986 - RNA, 12 nt, Artificial Sequence
  source: /note="Description of Artificial Sequence: Synthetic oligonucleotide"
accugcuuauuu

SEQ ID NO: 3987 - RNA, 12 nt, Artificial Sequence
  source: /note="Description of Artificial Sequence: Synthetic oligonucleotide"
caccugcuuauu

SEQ ID NO: 3988 - RNA, 12 nt, Artificial Sequence
  source: /note="Description of Artificial Sequence: Synthetic oligonucleotide"
ccaccugcuuau

SEQ ID NO: 3989 - RNA, 12 nt, Artificial Sequence
  source: /note="Description of Artificial Sequence: Synthetic oligonucleotide"
uccaccugcuua

SEQ ID NO: 3990 - RNA, 12 nt, Artificial Sequence
  source: /note="Description of Artificial Sequence: Synthetic oligonucleotide"
auccaccugcuu

SEQ ID NO: 3991 - RNA, 12 nt, Artificial Sequence
  source: /note="Description of Artificial Sequence: Synthetic oligonucleotide"
gauccaccugcu

SEQ ID NO: 3992 - RNA, 12 nt, Artificial Sequence
  source: /note="Description of Artificial Sequence: Synthetic oligonucleotide"
agauccaccugc

SEQ ID NO: 3993 - RNA, 12 nt, Artificial Sequence
  source: /note="Description of Artificial Sequence: Synthetic oligonucleotide"
uagauccaccug

SEQ ID NO: 3994 - RNA, 12 nt, Artificial Sequence
  source: /note="Description of Artificial Sequence: Synthetic oligonucleotide"
auagauccaccu

SEQ ID NO: 3995 - RNA, 12 nt, Artificial Sequence
  source: /note="Description of Artificial Sequence: Synthetic oligonucleotide"
aauagauccacc

SEQ ID NO: 3996 - RNA, 12 nt, Artificial Sequence
  source: /note="Description of Artificial Sequence: Synthetic oligonucleotide"
aaauagauccac

SEQ ID NO: 3997 - RNA, 12 nt, Artificial Sequence
  source: /note="Description of Artificial Sequence: Synthetic oligonucleotide"
gaaauagaucca

SEQ ID NO: 3998 - RNA, 12 nt, Artificial Sequence
  source: /note="Description of Artificial Sequence: Synthetic oligonucleotide"
ugaaauagaucc

SEQ ID NO: 3999 - RNA, 12 nt, Artificial Sequence
  source: /note="Description of Artificial Sequence: Synthetic oligonucleotide"
augaaauagauc

SEQ ID NO: 4000 - RNA, 12 nt, Artificial Sequence
  source: /note="Description of Artificial Sequence: Synthetic oligonucleotide"
caugaaauagau

SEQ ID NO: 4001 - RNA, 12 nt, Artificial Sequence
  source: /note="Description of Artificial Sequence: Synthetic oligonucleotide"
cauaucccaaau

SEQ ID NO: 4002 - RNA, 12 nt, Artificial Sequence
  source: /note="Description of Artificial Sequence: Synthetic oligonucleotide"
acauaucccaaa

SEQ ID NO: 4003 - RNA, 12 nt, Artificial Sequence
  source: /note="Description of Artificial Sequence: Synthetic oligonucleotide"
uacauaucccaa

SEQ ID NO: 4004 - RNA, 12 nt, Artificial Sequence
  source: /note="Description of Artificial Sequence: Synthetic oligonucleotide"
auacauauccca

SEQ ID NO: 4005 - RNA, 12 nt, Artificial Sequence
  source: /note="Description of Artificial Sequence: Synthetic oligonucleotide"
cauacauauccc

SEQ ID NO: 4006 - RNA, 12 nt, Artificial Sequence
  source: /note="Description of Artificial Sequence: Synthetic oligonucleotide"
ccauacauaucc

SEQ ID NO: 4007 - RNA, 12 nt, Artificial Sequence
  source: /note="Description of Artificial Sequence: Synthetic oligonucleotide"
cccauacauauc

SEQ ID NO: 4008 - RNA, 12 nt, Artificial Sequence
  source: /note="Description of Artificial Sequence: Synthetic oligonucleotide"
acccauacauau

SEQ ID NO: 4009 - RNA, 12 nt, Artificial Sequence
  source: /note="Description of Artificial Sequence: Synthetic oligonucleotide"
uacccauacaua

SEQ ID NO: 4010 - RNA, 12 nt, Artificial Sequence
  source: /note="Description of Artificial Sequence: Synthetic oligonucleotide"
cuacccauacau

SEQ ID NO: 4011 - RNA, 12 nt, Artificial Sequence
  source: /note="Description of Artificial Sequence: Synthetic oligonucleotide"
ccuacccauaca

SEQ ID NO: 4012 - RNA, 12 nt, Artificial Sequence
  source: /note="Description of Artificial Sequence: Synthetic oligonucleotide"
cccuacccauac

SEQ ID NO: 4013 - RNA, 12 nt, Artificial Sequence
  source: /note="Description of Artificial Sequence: Synthetic oligonucleotide"
acccuacccaua

SEQ ID NO: 4014 - RNA, 12 nt, Artificial Sequence
  source: /note="Description of Artificial Sequence: Synthetic oligonucleotide"
auuuacccuacc

SEQ ID NO: 4015 - RNA, 12 nt, Artificial Sequence
  source: /note="Description of Artificial Sequence: Synthetic oligonucleotide"
gauuuacccuac

SEQ ID NO: 4016 - RNA, 12 nt, Artificial Sequence
  source: /note="Description of Artificial Sequence: Synthetic oligonucleotide"
ugauuuacccua

SEQ ID NO: 4017 - RNA, 12 nt, Artificial Sequence
  source: /note="Description of Artificial Sequence: Synthetic oligonucleotide"
cugauuuacccu

SEQ ID NO: 4018 - RNA, 12 nt, Artificial Sequence
  source: /note="Description of Artificial Sequence: Synthetic oligonucleotide"
acugauuuaccc

SEQ ID NO: 4019 - RNA, 12 nt, Artificial Sequence
  source: /note="Description of Artificial Sequence: Synthetic oligonucleotide"
uacugauuuacc

SEQ ID NO: 4020 - RNA, 12 nt, Artificial Sequence
  source: /note="Description of Artificial Sequence: Synthetic oligonucleotide"
uuacugauuuac

SEQ ID NO: 4021 - RNA, 12 nt, Artificial Sequence
  source: /note="Description of Artificial Sequence: Synthetic oligonucleotide"
cuuacugauuua

SEQ ID NO: 4022 - RNA, 12 nt, Artificial Sequence
  source: /note="Description of Artificial Sequence: Synthetic oligonucleotide"
ucuuacugauuu

SEQ ID NO: 4023 - RNA, 12 nt, Artificial Sequence
  source: /note="Description of Artificial Sequence: Synthetic oligonucleotide"
cucuuacugauu

SEQ ID NO: 4024 - RNA, 12 nt, Artificial Sequence
  source: /note="Description of Artificial Sequence: Synthetic oligonucleotide"
ccucuuacugau

SEQ ID NO: 4025 - RNA, 12 nt, Artificial Sequence
  source: /note="Description of Artificial Sequence: Synthetic oligonucleotide"
accucuuacuga

SEQ ID NO: 4026 - RNA, 12 nt, Artificial Sequence
  source: /note="Description of Artificial Sequence: Synthetic oligonucleotide"
caccucuuacug

SEQ ID NO: 4027 - RNA, 12 nt, Artificial Sequence
  source: /note="Description of Artificial Sequence: Synthetic oligonucleotide"
acaccucuuacu

SEQ ID NO: 4028 - RNA, 12 nt, Artificial Sequence
  source: /note="Description of Artificial Sequence: Synthetic oligonucleotide"
aacaccucuuac

SEQ ID NO: 4029 - RNA, 12 nt, Artificial Sequence
  source: /note="Description of Artificial Sequence: Synthetic oligonucleotide"
uaacaccucuua

SEQ ID NO: 4030 - RNA, 12 nt, Artificial Sequence
  source: /note="Description of Artificial Sequence: Synthetic oligonucleotide"
auaacaccucuu

SEQ ID NO: 4031 - RNA, 12 nt, Artificial Sequence
  source: /note="Description of Artificial Sequence: Synthetic oligonucleotide"
aauaacaccucu

SEQ ID NO: 4032 - RNA, 12 nt, Artificial Sequence
  source: /note="Description of Artificial Sequence: Synthetic oligonucleotide"
aaauaacaccuc

SEQ ID NO: 4033 - RNA, 12 nt, Artificial Sequence
  source: /note="Description of Artificial Sequence: Synthetic oligonucleotide"
caaauaacaccu

SEQ ID NO: 4034 - RNA, 12 nt, Artificial Sequence
  source: /note="Description of Artificial Sequence: Synthetic oligonucleotide"
ccaaauaacacc

SEQ ID NO: 4035 - RNA, 12 nt, Artificial Sequence
  source: /note="Description of Artificial Sequence: Synthetic oligonucleotide"
uccaaauaacac

SEQ ID NO: 4036 - RNA, 12 nt, Artificial Sequence
  source: /note="Description of Artificial Sequence: Synthetic oligonucleotide"
uuccaaauaaca

SEQ ID NO: 4037 - RNA, 12 nt, Artificial Sequence
  source: /note="Description of Artificial Sequence: Synthetic oligonucleotide"
guuccaaauaac

SEQ ID NO: 4038 - RNA, 12 nt, Artificial Sequence
  source: /note="Description of Artificial Sequence: Synthetic oligonucleotide"
gguuccaaauaa

SEQ ID NO: 4039 - RNA, 12 nt, Artificial Sequence
  source: /note="Description of Artificial Sequence: Synthetic oligonucleotide"
aaacaagguucc

SEQ ID NO: 4040 - RNA, 12 nt, Artificial Sequence
  source: /note="Description of Artificial Sequence: Synthetic oligonucleotide"
aaaacaagguuc

SEQ ID NO: 4041 - RNA, 12 nt, Artificial Sequence
  source: /note="Description of Artificial Sequence: Synthetic oligonucleotide"
caaaacaagguu

SEQ ID NO: 4042 - RNA, 12 nt, Artificial Sequence
  source: /note="Description of Artificial Sequence: Synthetic oligonucleotide"
ccaaaacaaggu

SEQ ID NO: 4043 - RNA, 12 nt, Artificial Sequence
  source: /note="Description of Artificial Sequence: Synthetic oligonucleotide"
uccaaaacaagg

SEQ ID NO: 4044 - RNA, 12 nt, Artificial Sequence
  source: /note="Description of Artificial Sequence: Synthetic oligonucleotide"
guccaaaacaag

SEQ ID NO: 4045 - RNA, 12 nt, Artificial Sequence
  source: /note="Description of Artificial Sequence: Synthetic oligonucleotide"
uguccaaaacaa

SEQ ID NO: 4046 - RNA, 12 nt, Artificial Sequence
  source: /note="Description of Artificial Sequence: Synthetic oligonucleotide"
cuguccaaaaca

SEQ ID NO: 4047 - RNA, 12 nt, Artificial Sequence
  source: /note="Description of Artificial Sequence: Synthetic oligonucleotide"
acuguccaaaac

SEQ ID NO: 4048 - RNA, 12 nt, Artificial Sequence
  source: /note="Description of Artificial Sequence: Synthetic oligonucleotide"
aacuguccaaaa

SEQ ID NO: 4049 - RNA, 12 nt, Artificial Sequence
  source: /note="Description of Artificial Sequence: Synthetic oligonucleotide"
aaacuguccaaa

SEQ ID NO: 4050 - RNA, 12 nt, Artificial Sequence
  source: /note="Description of Artificial Sequence: Synthetic oligonucleotide"
uaaacuguccaa

SEQ ID NO: 4051 - RNA, 12 nt, Artificial Sequence
  source: /note="Description of Artificial Sequence: Synthetic oligonucleotide"
guaaacugucca

SEQ ID NO: 4052 - RNA, 12 nt, Artificial Sequence
  source: /note="Description of Artificial Sequence: Synthetic oligonucleotide"
gguaaacugucc

SEQ ID NO: 4053 - RNA, 12 nt, Artificial Sequence
  source: /note="Description of Artificial Sequence: Synthetic oligonucleotide"
ugguaaacuguc

SEQ ID NO: 4054 - RNA, 12 nt, Artificial Sequence
  source: /note="Description of Artificial Sequence: Synthetic oligonucleotide"
cugguaaacugu

SEQ ID NO: 4055 - RNA, 12 nt, Artificial Sequence
  source: /note="Description of Artificial Sequence: Synthetic oligonucleotide"
acugguaaacug

SEQ ID NO: 4056 - RNA, 12 nt, Artificial Sequence
  source: /note="Description of Artificial Sequence: Synthetic oligonucleotide"
aacugguaaacu

SEQ ID NO: 4057 - RNA, 12 nt, Artificial Sequence
  source: /note="Description of Artificial Sequence: Synthetic oligonucleotide"
aaggcaacuggu

SEQ ID NO: 4058 - RNA, 12 nt, Artificial Sequence
  source: /note="Description of Artificial Sequence: Synthetic oligonucleotide"
aaaggcaacugg

SEQ ID NO: 4059 - RNA, 12 nt, Artificial Sequence
  source: /note="Description of Artificial Sequence: Synthetic oligonucleotide"
aaaaggcaacug

SEQ ID NO: 4060 - RNA, 12 nt, Artificial Sequence
  source: /note="Description of Artificial Sequence: Synthetic oligonucleotide"
uaaaaggcaacu

SEQ ID NO: 4061 - RNA, 12 nt, Artificial Sequence
  source: /note="Description of Artificial Sequence: Synthetic oligonucleotide"
auaaaaggcaac

SEQ ID NO: 4062 - RNA, 12 nt, Artificial Sequence
  source: /note="Description of Artificial Sequence: Synthetic oligonucleotide"
gauaaaaggcaa

SEQ ID NO: 4063 - RNA, 12 nt, Artificial Sequence
  source: /note="Description of Artificial Sequence: Synthetic oligonucleotide"
ggauaaaaggca

SEQ ID NO: 4064 - RNA, 12 nt, Artificial Sequence
  source: /note="Description of Artificial Sequence: Synthetic oligonucleotide"
gggauaaaaggc

SEQ ID NO: 4065 - RNA, 12 nt, Artificial Sequence
  source: /note="Description of Artificial Sequence: Synthetic oligonucleotide"
ugggauaaaagg

SEQ ID NO: 4066 - RNA, 12 nt, Artificial Sequence
  source: /note="Description of Artificial Sequence: Synthetic oligonucleotide"
uugggauaaaag

SEQ ID NO: 4067 - RNA, 12 nt, Artificial Sequence
  source: /note="Description of Artificial Sequence: Synthetic oligonucleotide"
uuugggauaaaa

SEQ ID NO: 4068 - RNA, 12 nt, Artificial Sequence
  source: /note="Description of Artificial Sequence: Synthetic oligonucleotide"
cuuugggauaaa

SEQ ID NO: 4069 - RNA, 12 nt, Artificial Sequence
  source: /note="Description of Artificial Sequence: Synthetic oligonucleotide"
acuuugggauaa

SEQ ID NO: 4070 - RNA, 12 nt, Artificial Sequence
  source: /note="Description of Artificial Sequence: Synthetic oligonucleotide"
aacuuugggaua

SEQ ID NO: 4071 - RNA, 12 nt, Artificial Sequence
  source: /note="Description of Artificial Sequence: Synthetic oligonucleotide"
caacuuugggau

SEQ ID NO: 4072 - RNA, 12 nt, Artificial Sequence
  source: /note="Description of Artificial Sequence: Synthetic oligonucleotide"
acaacuuuggga

SEQ ID NO: 4073 - RNA, 12 nt, Artificial Sequence
  source: /note="Description of Artificial Sequence: Synthetic oligonucleotide"
aacaacuuuggg

SEQ ID NO: 4074 - RNA, 12 nt, Artificial Sequence
  source: /note="Description of Artificial Sequence: Synthetic oligonucleotide"
caacaacuuugg

SEQ ID NO: 4075 - RNA, 12 nt, Artificial Sequence
  source: /note="Description of Artificial Sequence: Synthetic oligonucleotide"
acaacaacuuug

SEQ ID NO: 4076 - RNA, 12 nt, Artificial Sequence
  source: /note="Description of Artificial Sequence: Synthetic oligonucleotide"
uacaacaacuuu

SEQ ID NO: 4077 - RNA, 12 nt, Artificial Sequence
  source: /note="Description of Artificial Sequence: Synthetic oligonucleotide"
uuacaacaacuu

SEQ ID NO: 4078 - RNA, 12 nt, Artificial Sequence
  source: /note="Description of Artificial Sequence: Synthetic oligonucleotide"
guuacaacaacu

SEQ ID NO: 4079 - RNA, 12 nt, Artificial Sequence
  source: /note="Description of Artificial Sequence: Synthetic oligonucleotide"
gguuacaacaac

SEQ ID NO: 4080 - RNA, 12 nt, Artificial Sequence
  source: /note="Description of Artificial Sequence: Synthetic oligonucleotide"
agguuacaacaa

SEQ ID NO: 4081 - RNA, 12 nt, Artificial Sequence
  source: /note="Description of Artificial Sequence: Synthetic oligonucleotide"
cagguuacaaca

SEQ ID NO: 4082 - RNA, 12 nt, Artificial Sequence
  source: /note="Description of Artificial Sequence: Synthetic oligonucleotide"
gcagguuacaac

SEQ ID NO: 4083 - RNA, 12 nt, Artificial Sequence
  source: /note="Description of Artificial Sequence: Synthetic oligonucleotide"
agcagguuacaa

SEQ ID NO: 4084 - RNA, 12 nt, Artificial Sequence
  source: /note="Description of Artificial Sequence: Synthetic oligonucleotide"
cagcagguuaca

SEQ ID NO: 4085 - RNA, 12 nt, Artificial Sequence
  source: /note="Description of Artificial Sequence: Synthetic oligonucleotide"
acagcagguuac

SEQ ID NO: 4086 - RNA, 12 nt, Artificial Sequence
  source: /note="Description of Artificial Sequence: Synthetic oligonucleotide"
cacagcagguua

SEQ ID NO: 4087 - RNA, 12 nt, Artificial Sequence
  source: /note="Description of Artificial Sequence: Synthetic oligonucleotide"
ucacagcagguu

SEQ ID NO: 4088 - RNA, 12 nt, Artificial Sequence
  source: /note="Description of Artificial Sequence: Synthetic oligonucleotide"
aucacagcaggu

SEQ ID NO: 4089 - RNA, 12 nt, Artificial Sequence
  source: /note="Description of Artificial Sequence: Synthetic oligonucleotide"
uaucacagcagg

SEQ ID NO: 4090 - RNA, 12 nt, Artificial Sequence
  source: /note="Description of Artificial Sequence: Synthetic oligonucleotide"
cauuuucucuug

SEQ ID NO: 4091 - RNA, 12 nt, Artificial Sequence
  source: /note="Description of Artificial Sequence: Synthetic oligonucleotide"
gcauuuucucuu

SEQ ID NO: 4092 - RNA, 12 nt, Artificial Sequence
  source: /note="Description of Artificial Sequence: Synthetic oligonucleotide"
cgcauuuucucu

SEQ ID NO: 4093 - RNA, 12 nt, Artificial Sequence
  source: /note="Description of Artificial Sequence: Synthetic oligonucleotide"
ccgcauuuucuc

SEQ ID NO: 4094 - RNA, 12 nt, Artificial Sequence
  source: /note="Description of Artificial Sequence: Synthetic oligonucleotide"
accgcauuuucu

SEQ ID NO: 4095 - RNA, 12 nt, Artificial Sequence
  source: /note="Description of Artificial Sequence: Synthetic oligonucleotide"
aaccgcauuuuc

SEQ ID NO: 4096 - RNA, 12 nt, Artificial Sequence
  source: /note="Description of Artificial Sequence: Synthetic oligonucleotide"
uaaccgcauuuu

SEQ ID NO: 4097 - RNA, 12 nt, Artificial Sequence
  source: /note="Description of Artificial Sequence: Synthetic oligonucleotide"
auaaccgcauuu

SEQ ID NO: 4098 - RNA, 12 nt, Artificial Sequence
  source: /note="Description of Artificial Sequence: Synthetic oligonucleotide"
uucugaaccauu

SEQ ID NO: 4099 - RNA, 12 nt, Artificial Sequence
  source: /note="Description of Artificial Sequence: Synthetic oligonucleotide"
auucugaaccau

SEQ ID NO: 4100 - RNA, 12 nt, Artificial Sequence
  source: /note="Description of Artificial Sequence: Synthetic oligonucleotide"
aauucugaacca

SEQ ID NO: 4101 - RNA, 12 nt, Artificial Sequence
  source: /note="Description of Artificial Sequence: Synthetic oligonucleotide"
uaauucugaacc

SEQ ID NO: 4102 - RNA, 12 nt, Artificial Sequence
  source: /note="Description of Artificial Sequence: Synthetic oligonucleotide"
uuaauucugaac

SEQ ID NO: 4103 - RNA, 12 nt, Artificial Sequence
  source: /note="Description of Artificial Sequence: Synthetic oligonucleotide"
uuuaauucugaa

SEQ ID NO: 4104 - RNA, 12 nt, Artificial Sequence
  source: /note="Description of Artificial Sequence: Synthetic oligonucleotide"
guuuaauucuga

SEQ ID NO: 4105 - RNA, 12 nt, Artificial Sequence
  source: /note="Description of Artificial Sequence: Synthetic oligonucleotide"
aguuuaauucug

SEQ ID NO: 4106 - RNA, 12 nt, Artificial Sequence
  source: /note="Description of Artificial Sequence: Synthetic oligonucleotide"
aaguuuaauucu

SEQ ID NO: 4107 - RNA, 12 nt, Artificial Sequence
  source: /note="Description of Artificial Sequence: Synthetic oligonucleotide"
aaaguuuaauuc

SEQ ID NO: 4108 - RNA, 12 nt, Artificial Sequence
  source: /note="Description of Artificial Sequence: Synthetic oligonucleotide"
aaaaguuuaauu

SEQ ID NO: 4109-4111 - skipped (3 entries)

SEQ ID NO: 4112 - DNA, 3256 bp, Homo sapiens
aggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattg

SEQ ID NO: 4113 - DNA, 3346 bp, Macaca fascicularis
cgccattttaagcctcttggtctgtggcagccgtgttggcccggccccgagagcggagagcgaggggaggcggagacggaggaaggtccgaggagcagcttcagtcctcgccgagccgccaccgcaggtcgaggacggtcggactcccgcgacgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgatgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgggagggcttgttggccatctttaagtctggaggcattcctgccctggtgaaaatgcttggttcaccagtggattctgtgttgttttatgccattacaactctccacaaccttttattacatcaagaaggagctaaaatggcagtgcgtttagctggcgggctacagaaaatggttgccttgctcaacaaaacaaacgttaaattcttggctattacgacagactgccttcagattttagcatatggcaaccaagaaagcaagctgatcatactggctagtggtggaccccaagctttagtaaatataatgaggacctatacttatgagaaactactgtggaccacaagcagagtgctgaaggtgctatccgtctgctctagtaataagccagctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaataagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtccagcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtactggagcccttcacatcctagctcgggatgttcacaaccgaattgtaatcagaggactaaataccattccattgtttgtgcagctgctttattctcccattgaaaacatccaaagagtagctgcaggggtcctctgtgaacttgctcaggacaaggaagctgcagaagcgattgaagctgagggagccacagctcctctgacagagttacttcactctaggaatgaaggtgtggcgacgtatgcagctgctgttttgttccgaatgtctgaggacaagccacaagattacaagaaacggctttcagttgagctgaccagctctctcttcagaacggagccaatggcttggaatgagactgcggatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctgggacatgcccaggacctcatggatgggctgcctccaggtgatagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaataattgtaatctgaataaagtgtaacattgtgtagcctttttgtataaaatagacaaatagaaaatggtccaattagtttcctttttaatatgcttaaaataagcaggtggatctatttcatgtttttgatcaaaaactttatttgggatatgtatgggtagggtaaatcagtaagaggtgttatttggaaccttgttttggacagtttaccagttgccttttatcccaaagttgttgtaacctgctgtgatacaatgcttcaagagaaaatgcggttataaaaaatggttcagaa

SEQ ID NO: 4114-4770 - skipped (657 entries)

SEQ ID NO: 4771 - RNA, 19 nt, Artificial Sequence
  source: /note="Description of Artificial Sequence: Synthetic oligonucleotide"
uggugcugacuauccaguu

SEQ ID NO: 4772 - RNA, 19 nt, Artificial Sequence
  source: /note="Description of Artificial Sequence: Synthetic oligonucleotide"
ccaucugugcucuucguca

SEQ ID NO: 4773 - RNA, 19 nt, Artificial Sequence
  source: /note="Description of Artificial Sequence: Synthetic oligonucleotide"
auaagcagguggaucuauu

SEQ ID NO: 4774 - RNA, 19 nt, Artificial Sequence
  source: /note="Description of Artificial Sequence: Synthetic oligonucleotide"
auccaaagaguagcugcag

SEQ ID NO: 4775 - RNA, 19 nt, Artificial Sequence
  source: /note="Description of Artificial Sequence: Synthetic oligonucleotide"
gacaauggcuacucaagcu

SEQ ID NO: 4776 - RNA, 19 nt, Artificial Sequence
  source: /note="Description of Artificial Sequence: Synthetic oligonucleotide"
cuguuggauugauucgaaa

SEQ ID NO: 4777 - RNA, 19 nt, Artificial Sequence
  source: /note="Description of Artificial Sequence: Synthetic oligonucleotide"
gcuggccugguuugauacu

SEQ ID NO: 4778 - RNA, 19 nt, Artificial Sequence
  source: /note="Description of Artificial Sequence: Synthetic oligonucleotide"
ucuaaccucacuugcaaua

SEQ ID NO: 4779 - RNA, 19 nt, Artificial Sequence
  source: /note="Description of Artificial Sequence: Synthetic oligonucleotide"
gauaucgccaggaugaucc

SEQ ID NO: 4780 - RNA, 19 nt, Artificial Sequence
  source: /note="Description of Artificial Sequence: Synthetic oligonucleotide"
uggccaucuuuaagucugg

SEQ ID NO: 4781 - RNA, 19 nt, Artificial Sequence
  source: /note="Description of Artificial Sequence: Synthetic oligonucleotide"
uguagaacacuaauucaua

SEQ ID NO: 4782 - RNA, 19 nt, Artificial Sequence
  source: /note="Description of Artificial Sequence: Synthetic oligonucleotide"
aucaguaagagguguuauu

SEQ ID NO: 4783 - RNA, 19 nt, Artificial Sequence
  source: /note="Description of Artificial Sequence: Synthetic oligonucleotide"
gugcucuucgucaucugac

SEQ ID NO: 4784 - RNA, 19 nt, Artificial Sequence
  source: /note="Description of Artificial Sequence: Synthetic oligonucleotide"
ugguuugauacugaccugu

SEQ ID NO: 4785 - RNA, 19 nt, Artificial Sequence
  source: /note="Description of Artificial Sequence: Synthetic oligonucleotide"
ccaguugccuuuuauccca

SEQ ID NO: 4786 - RNA, 19 nt, Artificial Sequence
  source: /note="Description of Artificial Sequence: Synthetic oligonucleotide"
ccugguuugauacugaccu

SEQ ID NO: 4787 - RNA, 19 nt, Artificial Sequence
  source: /note="Description of Artificial Sequence: Synthetic oligonucleotide"
gacuauccaguugaugggc

SEQ ID NO: 4788 - RNA, 19 nt, Artificial Sequence
  source: /note="Description of Artificial Sequence: Synthetic oligonucleotide"
agccaauggcuuggaauga

SEQ ID NO: 4789 - RNA, 19 nt, Artificial Sequence
  source: /note="Description of Artificial Sequence: Synthetic oligonucleotide"
gccaauggcuuggaaugag

SEQ ID NO: 4790 - RNA, 19 nt, Artificial Sequence
  source: /note="Description of Artificial Sequence: Synthetic oligonucleotide"
agaugagggcaugcagauc

SEQ ID NO: 4791 - RNA, 19 nt, Artificial Sequence
  source: /note="Description of Artificial Sequence: Synthetic oligonucleotide"
gguccucugugaacuugcu

SEQ ID NO: 4792 - RNA, 19 nt, Artificial Sequence
  source: /note="Description of Artificial Sequence: Synthetic oligonucleotide"
aacccuagccuugcuuguu

SEQ ID NO: 4793 - RNA, 19 nt, Artificial Sequence
  source: /note="Description of Artificial Sequence: Synthetic oligonucleotide"
gaacacuaauucauaauca

SEQ ID NO: 4794 - RNA, 19 nt, Artificial Sequence
  source: /note="Description of Artificial Sequence: Synthetic oligonucleotide"
aucaaacccuagccuugcu

SEQ ID NO: 4795 - RNA, 19 nt, Artificial Sequence
  source: /note="Description of Artificial Sequence: Synthetic oligonucleotide"
accaguugccuuuuauccc

SEQ ID NO: 4796 - RNA, 19 nt, Artificial Sequence
  source: /note="Description of Artificial Sequence: Synthetic oligonucleotide"
cuaaccucacuugcaauaa

SEQ ID NO: 4797 - RNA, 19 nt, Artificial Sequence
  source: /note="Description of Artificial Sequence: Synthetic oligonucleotide"
aucccacuaauguccagcg

SEQ ID NO: 4798 - RNA, 19 nt, Artificial Sequence
  source: /note="Description of Artificial Sequence: Synthetic oligonucleotide"
cugacuauccaguugaugg

SEQ ID NO: 4799 - RNA, 19 nt, Artificial Sequence
  source: /note="Description of Artificial Sequence: Synthetic oligonucleotide"
ggccugguuugauacugac

SEQ ID NO: 4800 - RNA, 19 nt, Artificial Sequence
  source: /note="Description of Artificial Sequence: Synthetic oligonucleotide"
gguaaaucaguaagaggug

SEQ ID NO: 4801 - RNA, 19 nt, Artificial Sequence
  source: /note="Description of Artificial Sequence: Synthetic oligonucleotide"
gccugguuugauacugacc

SEQ ID NO: 4802 - RNA, 19 nt, Artificial Sequence
  source: /note="Description of Artificial Sequence: Synthetic oligonucleotide"
cagggguccucugugaacu

SEQ ID NO: 4803 - RNA, 19 nt, Artificial Sequence
  source: /note="Description of Artificial Sequence: Synthetic oligonucleotide"
cuggaauccauucuggugc

SEQ ID NO: 4804 - RNA, 19 nt, Artificial Sequence
  source: /note="Description of Artificial Sequence: Synthetic oligonucleotide"
ugagauggguggccaccac

SEQ ID NO: 4805 - RNA, 19 nt, Artificial Sequence
  source: /note="Description of Artificial Sequence: Synthetic oligonucleotide"
gaugauauaaaugugguca

SEQ ID NO: 4806 - RNA, 19 nt, Artificial Sequence
  source: /note="Description of Artificial Sequence: Synthetic oligonucleotide"
ugcuuuauucucccauuga

SEQ ID NO: 4807 - RNA, 19 nt, Artificial Sequence
  source: /note="Description of Artificial Sequence: Synthetic oligonucleotide"
uuaucaaacccuagccuug

SEQ ID NO: 4808 - RNA, 19 nt, Artificial Sequence
  source: /note="Description of Artificial Sequence: Synthetic oligonucleotide"
ccacuggccucugauaaag

SEQ ID NO: 4809 - RNA, 19 nt, Artificial Sequence
  source: /note="Description of Artificial Sequence: Synthetic oligonucleotide"
aacuugccacacgugcaau

SEQ ID NO: 4810 - RNA, 19 nt, Artificial Sequence
  source: /note="Description of Artificial Sequence: Synthetic oligonucleotide"
gcucuucgucaucugacca

SEQ ID NO: 4811 - RNA, 19 nt, Artificial Sequence
  source: /note="Description of Artificial Sequence: Synthetic oligonucleotide"
guaacaauacaaauggauu

SEQ ID NO: 4812 - RNA, 19 nt, Artificial Sequence
  source: /note="Description of Artificial Sequence: Synthetic oligonucleotide"
gggguccucugugaacuug

SEQ ID NO: 4813 - RNA, 19 nt, Artificial Sequence
  source: /note="Description of Artificial Sequence: Synthetic oligonucleotide"
caaacccuagccuugcuug

SEQ ID NO: 4814 - RNA, 19 nt, Artificial Sequence
  source: /note="Description of Artificial Sequence: Synthetic oligonucleotide"
gaguaaugguguagaacac

SEQ ID NO: 4815 - RNA, 19 nt, Artificial Sequence
  source: /note="Description of Artificial Sequence: Synthetic oligonucleotide"
ggaagacaucacugagccu

SEQ ID NO: 4816 - RNA, 19 nt, Artificial Sequence
  source: /note="Description of Artificial Sequence: Synthetic oligonucleotide"
gggaagacaucacugagcc

SEQ ID NO: 4817 - RNA, 19 nt, Artificial Sequence
  source: /note="Description of Artificial Sequence: Synthetic oligonucleotide"
gguguagaacacuaauuca

SEQ ID NO: 4818 - RNA, 19 nt, Artificial Sequence
  source: /note="Description of Artificial Sequence: Synthetic oligonucleotide"
uaccaguugccuuuuaucc

SEQ ID NO: 4819 - RNA, 19 nt, Artificial Sequence
  source: /note="Description of Artificial Sequence: Synthetic oligonucleotide"
ggauaucgccaggaugauc

SEQ ID NO: 4820 - RNA, 19 nt, Artificial Sequence
  source: /note="Description of Artificial Sequence: Synthetic oligonucleotide"
aaacccuagccuugcuugu

SEQ ID NO: 4821 - RNA, 19 nt, Artificial Sequence
  source: /note="Description of Artificial Sequence: Synthetic oligonucleotide"
cucuucgucaucugaccag

SEQ ID NO: 4822 - RNA, 19 nt, Artificial Sequence
  source: /note="Description of Artificial Sequence: Synthetic oligonucleotide"
ugacuauccaguugauggg

SEQ ID NO: 4823 - RNA, 19 nt, Artificial Sequence
  source: /note="Description of Artificial Sequence: Synthetic oligonucleotide"
acaagcagagugcugaagg

SEQ ID NO: 4824 - RNA, 19 nt, Artificial Sequence
  source: /note="Description of Artificial Sequence: Synthetic oligonucleotide"
caucugugcucuucgucau

SEQ ID NO: 4825 - RNA, 19 nt, Artificial Sequence
  source: /note="Description of Artificial Sequence: Synthetic oligonucleotide"
caauggcuuggaaugagac

SEQ ID NO: 4826 - RNA, 19 nt, Artificial Sequence
  source: /note="Description of Artificial Sequence: Synthetic oligonucleotide"
acuggccucugauaaaggc

SEQ ID NO: 4827 - RNA, 19 nt, Artificial Sequence
  source: /note="Description of Artificial Sequence: Synthetic oligonucleotide"
ucaucccacuaauguccag

SEQ ID NO: 4828 - RNA, 19 nt, Artificial Sequence
  source: /note="Description of Artificial Sequence: Synthetic oligonucleotide"
aaaaggaagcuuccagaca

SEQ ID NO: 4829 - RNA, 19 nt, Artificial Sequence
  source: /note="Description of Artificial Sequence: Synthetic oligonucleotide"
cguucuuuucacucuggug

SEQ ID NO: 4830 - RNA, 19 nt, Artificial Sequence
  source: /note="Description of Artificial Sequence: Synthetic oligonucleotide"
aaaguuguuguaaccugcu

SEQ ID NO: 4831 - RNA, 19 nt, Artificial Sequence
  source: /note="Description of Artificial Sequence: Synthetic oligonucleotide"
acaauggcuacucaagcug

SEQ ID NO: 4832 - RNA, 19 nt, Artificial Sequence
  source: /note="Description of Artificial Sequence: Synthetic oligonucleotide"
cucaucccacuaaugucca

SEQ ID NO: 4833 - RNA, 19 nt, Artificial Sequence
  source: /note="Description of Artificial Sequence: Synthetic oligonucleotide"
agggguccucugugaacuu

SEQ ID NO: 4834 - RNA, 19 nt, Artificial Sequence
  source: /note="Description of Artificial Sequence: Synthetic oligonucleotide"
aagcagguggaucuauuuc

SEQ ID NO: 4835 - RNA, 19 nt, Artificial Sequence
  source: /note="Description of Artificial Sequence: Synthetic oligonucleotide"
aaguuguuguaaccugcug

SEQ ID NO: 4836 - RNA, 19 nt, Artificial Sequence
  source: /note="Description of Artificial Sequence: Synthetic oligonucleotide"
agcagguggaucuauuuca

SEQ ID NO: 4837 - RNA, 19 nt, Artificial Sequence
  source: /note="Description of Artificial Sequence: Synthetic oligonucleotide"
agggcaugcagaucccauc

SEQ ID NO: 4838 - RNA, 19 nt, Artificial Sequence
  source: /note="Description of Artificial Sequence: Synthetic oligonucleotide"
aaaugguucagaauuaaac

SEQ ID NO: 4839 - RNA, 19 nt, Artificial Sequence
  source: /note="Description of Artificial Sequence: Synthetic oligonucleotide"
ugaacuugcucaggacaag

SEQ ID NO: 4840 - RNA, 19 nt, Artificial Sequence
  source: /note="Description of Artificial Sequence: Synthetic oligonucleotide"
aagaguagcugcagggguc

SEQ ID NO: 4841 - RNA, 19 nt, Artificial Sequence
  source: /note="Description of Artificial Sequence: Synthetic oligonucleotide"
cccacuggccucugauaaa

SEQ ID NO: 4842 - RNA, 19 nt, Artificial Sequence
  source: /note="Description of Artificial Sequence: Synthetic oligonucleotide"
cuggccugguuugauacug

SEQ ID NO: 4843 - RNA, 19 nt, Artificial Sequence
  source: /note="Description of Artificial Sequence: Synthetic oligonucleotide"
uugauacugaccuguaaau

SEQ ID NO: 4844 - RNA, 19 nt, Artificial Sequence
  source: /note="Description of Artificial Sequence: Synthetic oligonucleotide"
guguagaacacuaauucau

SEQ ID NO: 4845 - RNA, 19 nt, Artificial Sequence
  source: /note="Description of Artificial Sequence: Synthetic oligonucleotide"
acuauccaguugaugggcu

SEQ ID NO: 4846 - RNA, 19 nt, Artificial Sequence
  source: /note="Description of Artificial Sequence: Synthetic oligonucleotide"
aaaucaguaagagguguua

SEQ ID NO: 4847 - RNA, 19 nt, Artificial Sequence
  source: /note="Description of Artificial Sequence: Synthetic oligonucleotide"
gcagguggaucuauuucau

SEQ ID NO: 4848 - RNA, 19 nt, Artificial Sequence
  source: /note="Description of Artificial Sequence: Synthetic oligonucleotide"
cuggugcugacuauccagu

SEQ ID NO: 4849 - RNA, 19 nt, Artificial Sequence
  source: /note="Description of Artificial Sequence: Synthetic oligonucleotide"
gugaacuugcucaggacaa

SEQ ID NO: 4850 - RNA, 19 nt, Artificial Sequence
  source: /note="Description of Artificial Sequence: Synthetic oligonucleotide"
ucaguaagagguguuauuu

SEQ ID NO: 4851 - RNA, 19 nt, Artificial Sequence
  source: /note="Description of Artificial Sequence: Synthetic oligonucleotide"
ccucugugaacuugcucag

SEQ ID NO: 4852 - RNA, 19 nt, Artificial Sequence
  source: /note="Description of Artificial Sequence: Synthetic oligonucleotide"
uuggcugaaccaucacaga

SEQ ID NO: 4853 - RNA, 19 nt, Artificial Sequence
  source: /note="Description of Artificial Sequence: Synthetic oligonucleotide"
ucagcuggccugguuugau

SEQ ID NO: 4854 - RNA, 19 nt, Artificial Sequence
  source: /note="Description of Artificial Sequence: Synthetic oligonucleotide"
guagcugcagggguccucu

SEQ ID NO: 4855 - RNA, 19 nt, Artificial Sequence
  source: /note="Description of Artificial Sequence: Synthetic oligonucleotide"
aggagcuaaaauggcagug

SEQ ID NO: 4856 - RNA, 19 nt, Artificial Sequence
  source: /note="Description of Artificial Sequence: Synthetic oligonucleotide"
auggcuuggaaugagacug

SEQ ID NO: 4857 - RNA, 19 nt, Artificial Sequence
  source: /note="Description of Artificial Sequence: Synthetic oligonucleotide"
uuggauaucgccaggauga

SEQ ID NO: 4858 - RNA, 19 nt, Artificial Sequence
  source: /note="Description of Artificial Sequence: Synthetic oligonucleotide"
gguucagaauuaaacuuuu

SEQ ID NO: 4859 - RNA, 19 nt, Artificial Sequence
  source: /note="Description of Artificial Sequence: Synthetic oligonucleotide"
ggguaaaucaguaagaggu

SEQ ID NO: 4860 - RNA, 19 nt, Artificial Sequence
  source: /note="Description of Artificial Sequence: Synthetic oligonucleotide"
auaccauuccauuguuugu

SEQ ID NO: 4861 - RNA, 19 nt, Artificial Sequence
  source: /note="Description of Artificial Sequence: Synthetic oligonucleotide"
acuguuggauugauucgaa

SEQ ID NO: 4862 - RNA, 19 nt, Artificial Sequence
  source: /note="Description of Artificial Sequence: Synthetic oligonucleotide"
aacuugcucaggacaagga

SEQ ID NO: 4863 - RNA, 19 nt, Artificial Sequence
  source: /note="Description of Artificial Sequence: Synthetic oligonucleotide"
augcuuaaaauaagcaggu

SEQ ID NO: 4864 - RNA, 19 nt, Artificial Sequence
  source: /note="Description of Artificial Sequence: Synthetic oligonucleotide"
guuugauacugaccuguaa

SEQ ID NO: 4865 - RNA, 19 nt, Artificial Sequence
  source: /note="Description of Artificial Sequence: Synthetic oligonucleotide"
aaugguucagaauuaaacu

SEQ ID NO: 4866 - RNA, 19 nt, Artificial Sequence
  source: /note="Description of Artificial Sequence: Synthetic oligonucleotide"
uaucccaaaguuguuguaa

SEQ ID NO: 4867 - RNA, 19 nt, Artificial Sequence
  source: /note="Description of Artificial Sequence: Synthetic oligonucleotide"
aucagcuggccugguuuga

SEQ ID NO: 4868 - RNA, 19 nt, Artificial Sequence
  source: /note="Description of Artificial Sequence: Synthetic oligonucleotide"
ccugccaucugugcucuuc

SEQ ID NO: 4869 - RNA, 19 nt, Artificial Sequence
  source: /note="Description of Artificial Sequence: Synthetic oligonucleotide"
gcagaauacaaaugaugua

SEQ ID NO: 4870 - RNA, 19 nt, Artificial Sequence
  source: /note="Description of Artificial Sequence: Synthetic oligonucleotide"
uaugcuuaaaauaagcagg

SEQ ID NO: 4871 - RNA, 19 nt, Artificial Sequence
  source: /note="Description of Artificial Sequence: Synthetic oligonucleotide"
aauaagcagguggaucuau

SEQ ID NO: 4872 - RNA, 19 nt, Artificial Sequence
  source: /note="Description of Artificial Sequence: Synthetic oligonucleotide"
ugauauaaauguggucacc

SEQ ID NO: 4873 - RNA, 19 nt, Artificial Sequence
  source: /note="Description of Artificial Sequence: Synthetic oligonucleotide"
guaggguaaaucaguaaga

SEQ ID NO: 4874 - RNA, 19 nt, Artificial Sequence
  source: /note="Description of Artificial Sequence: Synthetic oligonucleotide"
uaucaaacccuagccuugc

SEQ ID NO: 4875 - RNA, 19 nt, Artificial Sequence
  source: /note="Description of Artificial Sequence: Synthetic oligonucleotide"
ccuuuuaucccaaaguugu

SEQ ID NO: 4876 - RNA, 19 nt, Artificial Sequence
  source: /note="Description of Artificial Sequence: Synthetic oligonucleotide"
gguaggguaaaucaguaag

SEQ ID NO: 4877 - RNA, 19 nt, Artificial Sequence
  source: /note="Description of Artificial Sequence: Synthetic oligonucleotide"
ugauacugaccuguaaauc

SEQ ID NO: 4878 - RNA, 19 nt, Artificial Sequence
  source: /note="Description of Artificial Sequence: Synthetic oligonucleotide"
ggcugaaccaucacagaug

SEQ ID NO: 4879 - RNA, 19 nt, Artificial Sequence
  source: /note="Description of Artificial Sequence: Synthetic oligonucleotide"
uggauaucgccaggaugau

SEQ ID NO: 4880 - RNA, 19 nt, Artificial Sequence
  source: /note="Description of Artificial Sequence: Synthetic oligonucleotide"
ucuucgucaucugaccagc

SEQ ID NO: 4881 - RNA, 19 nt, Artificial Sequence
  source: /note="Description of Artificial Sequence: Synthetic oligonucleotide"
uagcugcagggguccucug

SEQ ID NO: 4882 - RNA, 19 nt, Artificial Sequence
  source: /note="Description of Artificial Sequence: Synthetic oligonucleotide"
uguuguaaccugcugugau

SEQ ID NO: 4883 - RNA, 19 nt, Artificial Sequence
  source: /note="Description of Artificial Sequence: Synthetic oligonucleotide"
aaucaguaagagguguuau

SEQ ID NO: 4884 - RNA, 19 nt, Artificial Sequence
  source: /note="Description of Artificial Sequence: Synthetic oligonucleotide"
uggcugaaccaucacagau

SEQ ID NO: 4885 - RNA, 19 nt, Artificial Sequence
  source: /note="Description of Artificial Sequence: Synthetic oligonucleotide"
gaauuaaacuuuuaauuca

SEQ ID NO: 4886 - RNA, 19 nt, Artificial Sequence
  source: /note="Description of Artificial Sequence: Synthetic oligonucleotide"
augguucagaauuaaacuu

SEQ ID NO: 4887 - RNA, 19 nt, Artificial Sequence
  source: /note="Description of Artificial Sequence: Synthetic oligonucleotide"
ugguguagaacacuaauuc

SEQ ID NO: 4888 - RNA, 19 nt, Artificial Sequence
  source: /note="Description of Artificial Sequence: Synthetic oligonucleotide"
augguguagaacacuaauu

SEQ ID NO: 4889 - RNA, 19 nt, Artificial Sequence
  source: /note="Description of Artificial Sequence: Synthetic oligonucleotide"
augagggcaugcagauccc

SEQ ID NO: 4890 - RNA, 19 nt, Artificial Sequence
  source: /note="Description of Artificial Sequence: Synthetic oligonucleotide"
guuguaaccugcugugaua

SEQ ID NO: 4891 - RNA, 19 nt, Artificial Sequence
  source: /note="Description of Artificial Sequence: Synthetic oligonucleotide"
gcugacuauccaguugaug

SEQ ID NO: 4892 - RNA, 19 nt, Artificial Sequence
  source: /note="Description of Artificial Sequence: Synthetic oligonucleotide"
uaagcagguggaucuauuu

SEQ ID NO: 4893 - RNA, 19 nt, Artificial Sequence
  source: /note="Description of Artificial Sequence: Synthetic oligonucleotide"
uaaaauaagcagguggauc

SEQ ID NO: 4894 - RNA, 19 nt, Artificial Sequence
  source: /note="Description of Artificial Sequence: Synthetic oligonucleotide"
gauauaaauguggucaccu

SEQ ID NO: 4895 - RNA, 19 nt, Artificial Sequence
  source: /note="Description of Artificial Sequence: Synthetic oligonucleotide"
aagcagagugcugaaggug

SEQ ID NO: 4896 - RNA, 19 nt, Artificial Sequence
  source: /note="Description of Artificial Sequence: Synthetic oligonucleotide"
ugugaacuugcucaggaca

SEQ ID NO: 4897 - RNA, 19 nt, Artificial Sequence
  source: /note="Description of Artificial Sequence: Synthetic oligonucleotide"
caucccacuaauguccagc

SEQ ID NO: 4898 - RNA, 19 nt, Artificial Sequence
  source: /note="Description of Artificial Sequence: Synthetic oligonucleotide"
caaaguuguuguaaccugc

SEQ ID NO: 4899 - RNA, 19 nt, Artificial Sequence
  source: /note="Description of Artificial Sequence: Synthetic oligonucleotide"
uaaaucaguaagagguguu

SEQ ID NO: 4900 - RNA, 19 nt, Artificial Sequence
  source: /note="Description of Artificial Sequence: Synthetic oligonucleotide"
aauggcuuggaaugagacu

SEQ ID NO: 4901 - RNA, 19 nt, Artificial Sequence
  source: /note="Description of Artificial Sequence: Synthetic oligonucleotide"
ggguccucugugaacuugc

SEQ ID NO: 4902 - RNA, 19 nt, Artificial Sequence
  source: /note="Description of Artificial Sequence: Synthetic oligonucleotide"
gaguaacaauacaaaugga

SEQ ID NO: 4903 - RNA, 19 nt, Artificial Sequence
  source: /note="Description of Artificial Sequence: Synthetic oligonucleotide"
uaaugguguagaacacuaa

SEQ ID NO: 4904 - RNA, 19 nt, Artificial Sequence
  source: /note="Description of Artificial Sequence: Synthetic oligonucleotide"
guggacaauggcuacucaa

SEQ ID NO: 4905 - RNA, 19 nt, Artificial Sequence
  source: /note="Description of Artificial Sequence: Synthetic oligonucleotide"
aacugucuuuggacucuca

SEQ ID NO: 4906 - RNA, 19 nt, Artificial Sequence
  source: /note="Description of Artificial Sequence: Synthetic oligonucleotide"
cccuggugcugacuaucca

SEQ ID NO: 4907 - RNA, 19 nt, Artificial Sequence
  source: /note="Description of Artificial Sequence: Synthetic oligonucleotide"
cagguggaucuauuucaug

SEQ ID NO: 4908 - RNA, 19 nt, Artificial Sequence
  source: /note="Description of Artificial Sequence: Synthetic oligonucleotide"
uggccugguuugauacuga

SEQ ID NO: 4909 - RNA, 19 nt, Artificial Sequence
  source: /note="Description of Artificial Sequence: Synthetic oligonucleotide"
agcuggccugguuugauac

SEQ ID NO: 4910 - RNA, 19 nt, Artificial Sequence
  source: /note="Description of Artificial Sequence: Synthetic oligonucleotide"
gccaucugugcucuucguc

SEQ ID NO: 4911 - RNA, 19 nt, Artificial Sequence
  source: /note="Description of Artificial Sequence: Synthetic oligonucleotide"
uaccauuccauuguuugug

SEQ ID NO: 4912 - RNA, 19 nt, Artificial Sequence
  source: /note="Description of Artificial Sequence: Synthetic oligonucleotide"
cccuuggauaucgccagga

SEQ ID NO: 4913 - RNA, 19 nt, Artificial Sequence
  source: /note="Description of Artificial Sequence: Synthetic oligonucleotide"
agggaagacaucacugagc

SEQ ID NO: 4914 - RNA, 19 nt, Artificial Sequence
  source: /note="Description of Artificial Sequence: Synthetic oligonucleotide"
gaacuugccacacgugcaa

SEQ ID NO: 4915 - RNA, 19 nt, Artificial Sequence
  source: /note="Description of Artificial Sequence: Synthetic oligonucleotide"
uuugauacugaccuguaaa

SEQ ID NO: 4916 - RNA, 19 nt, Artificial Sequence
  source: /note="Description of Artificial Sequence: Synthetic oligonucleotide"
ucccaaaguuguuguaacc

SEQ ID NO: 4917 - RNA, 19 nt, Artificial Sequence
  source: /note="Description of Artificial Sequence: Synthetic oligonucleotide"
cagaauacaaaugauguag

SEQ ID NO: 4918 - RNA, 19 nt, Artificial Sequence
  source: /note="Description of Artificial Sequence: Synthetic oligonucleotide"
agguggaucuauuucaugu

SEQ ID NO: 4919 - RNA, 19 nt, Artificial Sequence
  source: /note="Description of Artificial Sequence: Synthetic oligonucleotide"
gcucaucccacuaaugucc

SEQ ID NO: 4920 - RNA, 19 nt, Artificial Sequence
  source: /note="Description of Artificial Sequence: Synthetic oligonucleotide"
ccuggugcugacuauccag

SEQ ID NO: 4921 - RNA, 19 nt, Artificial Sequence
  source: /note="Description of Artificial Sequence: Synthetic oligonucleotide"
uggaauccauucuggugcc

SEQ ID NO: 4922 - RNA, 19 nt, Artificial Sequence
  source: /note="Description of Artificial Sequence: Synthetic oligonucleotide"
ccaggaccucauggauggg

SEQ ID NO: 4923 - RNA, 19 nt, Artificial Sequence
  source: /note="Description of Artificial Sequence: Synthetic oligonucleotide"
aaccucacuugcaauaauu

SEQ ID NO: 4924 - RNA, 19 nt, Artificial Sequence
  source: /note="Description of Artificial Sequence: Synthetic oligonucleotide"
caguugccuuuuaucccaa

SEQ ID NO: 4925 - RNA, 19 nt, Artificial Sequence
  source: /note="Description of Artificial Sequence: Synthetic oligonucleotide"
guagaacacuaauucauaa

SEQ ID NO: 4926 - RNA, 19 nt, Artificial Sequence
  source: /note="Description of Artificial Sequence: Synthetic oligonucleotide"
cuauccaguugaugggcug

SEQ ID NO: 4927 - RNA, 19 nt, Artificial Sequence
  source: /note="Description of Artificial Sequence: Synthetic oligonucleotide"
cacuggccucugauaaagg

SEQ ID NO: 4928 - RNA, 19 nt, Artificial Sequence
  source: /note="Description of Artificial Sequence: Synthetic oligonucleotide"
acugucuuuggacucucag

SEQ ID NO: 4929 - RNA, 19 nt, Artificial Sequence
  source: /note="Description of Artificial Sequence: Synthetic oligonucleotide"
ccaauggcuuggaaugaga

SEQ ID NO: 4930 - RNA, 19 nt, Artificial Sequence
  source: /note="Description of Artificial Sequence: Synthetic oligonucleotide"
gcuuaaaauaagcaggugg

SEQ ID NO: 4931 - RNA, 19 nt, Artificial Sequence
  source: /note="Description of Artificial Sequence: Synthetic oligonucleotide"
aucugugcucuucgucauc

SEQ ID NO: 4932 - RNA, 19 nt, Artificial Sequence
  source: /note="Description of Artificial Sequence: Synthetic oligonucleotide"
cccaaaguuguuguaaccu

SEQ ID NO: 4933 - RNA, 19 nt, Artificial Sequence
  source: /note="Description of Artificial Sequence: Synthetic oligonucleotide"
uacccagcgccguacgucc

SEQ ID NO: 4934 - RNA, 19 nt, Artificial Sequence
  source: /note="Description of Artificial Sequence: Synthetic oligonucleotide"
acgcuaucaugcguucucc

SEQ ID NO: 4935 - RNA, 19 nt, Artificial Sequence
  source: /note="Description of Artificial Sequence: Synthetic oligonucleotide"
caugcaccuuugcgugagc

SEQ ID NO: 4936 - RNA, 19 nt, Artificial Sequence
  source: /note="Description of Artificial Sequence: Synthetic oligonucleotide"
gaaugcaguucgccuucac

SEQ ID NO: 4937 - RNA, 19 nt, Artificial Sequence
  source: /note="Description of Artificial Sequence: Synthetic oligonucleotide"
ggugccauuccacgacuag

SEQ ID NO: 4938 - RNA, 19 nt, Artificial Sequence
  source: /note="Description of Artificial Sequence: Synthetic oligonucleotide"
aagcggcuguuagucacug

SEQ ID NO: 4939 - RNA, 19 nt, Artificial Sequence
  source: /note="Description of Artificial Sequence: Synthetic oligonucleotide"
ucgagcucagaggguacga

SEQ ID NO: 4940 - RNA, 19 nt, Artificial Sequence
  source: /note="Description of Artificial Sequence: Synthetic oligonucleotide"
gacacgcuaucaugcguuc

SEQ ID NO: 4941 - RNA, 19 nt, Artificial Sequence
  source: /note="Description of Artificial Sequence: Synthetic oligonucleotide"
cgcuaucaugcguucuccu

SEQ ID NO: 4942 - RNA, 19 nt, Artificial Sequence
  source: /note="Description of Artificial Sequence: Synthetic oligonucleotide"
gugucugcuauuguacgua

SEQ ID NO: 4943 - RNA, 19 nt, Artificial Sequence
  source: /note="Description of Artificial Sequence: Synthetic oligonucleotide"
gucugcucuaguaauaagc

SEQ ID NO: 4944 - RNA, 19 nt, Artificial Sequence
  source: /note="Description of Artificial Sequence: Synthetic oligonucleotide"
gugccauuccacgacuagu

SEQ ID NO: 4945 - RNA, 19 nt, Artificial Sequence
  source: /note="Description of Artificial Sequence: Synthetic oligonucleotide"
auguucacaaccgaauugu

SEQ ID NO: 4946 - RNA, 19 nt, Artificial Sequence
  source: /note="Description of Artificial Sequence: Synthetic oligonucleotide"
ccacgacuaguucaguugc

SEQ ID NO: 4947 - RNA, 19 nt, Artificial Sequence
  source: /note="Description of Artificial Sequence: Synthetic oligonucleotide"
cacgacuaguucaguugcu

SEQ ID NO: 4948 - RNA, 19 nt, Artificial Sequence
  source: /note="Description of Artificial Sequence: Synthetic oligonucleotide"
aguucaguugcuuguucgu

SEQ ID NO: 4949 - RNA, 19 nt, Artificial Sequence
  source: /note="Description of Artificial Sequence: Synthetic oligonucleotide"
cccagcgccguacguccau

SEQ ID NO: 4950 - RNA, 19 nt, Artificial Sequence
  source: /note="Description of Artificial Sequence: Synthetic oligonucleotide"
gaguuacuucacucuagga

SEQ ID NO: 4951 - RNA, 19 nt, Artificial Sequence
  source: /note="Description of Artificial Sequence: Synthetic oligonucleotide"
acaguaugcaaugacucga

SEQ ID NO: 4952 - RNA, 19 nt, Artificial Sequence
  source: /note="Description of Artificial Sequence: Synthetic oligonucleotide"
uaugcaaugacucgagcuc

SEQ ID NO: 4953 - RNA, 19 nt, Artificial Sequence
  source: /note="Description of Artificial Sequence: Synthetic oligonucleotide"
cccacuaauguccagcguu

SEQ ID NO: 4954 - RNA, 19 nt, Artificial Sequence
  source: /note="Description of Artificial Sequence: Synthetic oligonucleotide"
gaccuugcauaaccuuucc

SEQ ID NO: 4955 - RNA, 19 nt, Artificial Sequence
  source: /note="Description of Artificial Sequence: Synthetic oligonucleotide"
uauuacgacagacugccuu

SEQ ID NO: 4956 - RNA, 19 nt, Artificial Sequence
  source: /note="Description of Artificial Sequence: Synthetic oligonucleotide"
aucugaccagccgacacca

SEQ ID NO: 4957 - RNA, 19 nt, Artificial Sequence
  source: /note="Description of Artificial Sequence: Synthetic oligonucleotide"
cauuccacgacuaguucag

SEQ ID NO: 4958 - RNA, 19 nt, Artificial Sequence
  source: /note="Description of Artificial Sequence: Synthetic oligonucleotide"
guuuugaaaauccagcgug

SEQ ID NO: 4959 - RNA, 19 nt, Artificial Sequence
  source: /note="Description of Artificial Sequence: Synthetic oligonucleotide"
gcguuuggcugaaccauca

SEQ ID NO: 4960 - RNA, 19 nt, Artificial Sequence
  source: /note="Description of Artificial Sequence: Synthetic oligonucleotide"
acacgcuaucaugcguucu

SEQ ID NO: 4961 - RNA, 19 nt, Artificial Sequence
  source: /note="Description of Artificial Sequence: Synthetic oligonucleotide"
uaugccauuacaacucucc

SEQ ID NO: 4962 - RNA, 19 nt, Artificial Sequence
  source: /note="Description of Artificial Sequence: Synthetic oligonucleotide"
ucugcucuaguaauaagcc

SEQ ID NO: 4963 - RNA, 19 nt, Artificial Sequence
  source: /note="Description of Artificial Sequence: Synthetic oligonucleotide"
cgggauguucacaaccgaa

SEQ ID NO: 4964 - RNA, 19 nt, Artificial Sequence
  source: /note="Description of Artificial Sequence: Synthetic oligonucleotide"
acaauacaaauggauuuug

SEQ ID NO: 4965 - RNA, 19 nt, Artificial Sequence
  source: /note="Description of Artificial Sequence: Synthetic oligonucleotide"
acaaauggauuuugggagu

SEQ ID NO: 4966 - RNA, 19 nt, Artificial Sequence
  source: /note="Description of Artificial Sequence: Synthetic oligonucleotide"
uugggagugacucaagaag

SEQ ID NO: 4967 - RNA, 19 nt, Artificial Sequence
  source: /note="Description of Artificial Sequence: Synthetic oligonucleotide"
ugggagugacucaagaagu

SEQ ID NO: 4968 - RNA, 19 nt, Artificial Sequence
  source: /note="Description of Artificial Sequence: Synthetic oligonucleotide"
gaagugaagaaugcacaag

SEQ ID NO: 4969 - RNA, 19 nt, Artificial Sequence
  source: /note="Description of Artificial Sequence: Synthetic oligonucleotide"
aagugaagaaugcacaaga

SEQ ID NO: 4970 - RNA, 19 nt, Artificial Sequence
  source: /note="Description of Artificial Sequence: Synthetic oligonucleotide"
gauggaauuuaucaaaccc

SEQ ID NO: 4971 - RNA, 19 nt, Artificial Sequence
  source: /note="Description of Artificial Sequence: Synthetic oligonucleotide"
auggaauuuaucaaacccu

SEQ ID NO: 4972 - RNA, 19 nt, Artificial Sequence
  source: /note="Description of Artificial Sequence: Synthetic oligonucleotide"
ggaauuuaucaaacccuag

SEQ ID NO: 4973 - RNA, 19 nt, Artificial Sequence
  source: /note="Description of Artificial Sequence: Synthetic oligonucleotide"
gaauuuaucaaacccuagc

SEQ ID NO: 4974 - RNA, 19 nt, Artificial Sequence
  source: /note="Description of Artificial Sequence: Synthetic oligonucleotide"
aauuuaucaaacccuagcc

SEQ ID NO: 4975 - RNA, 19 nt, Artificial Sequence
  source: /note="Description of Artificial Sequence: Synthetic oligonucleotide"
gaauaucuguaaugguacu

SEQ ID NO: 4976 - RNA, 19 nt, Artificial Sequence
  source: /note="Description of Artificial Sequence: Synthetic oligonucleotide"
aauaucuguaaugguacug

SEQ ID NO: 4977 - RNA, 19 nt, Artificial Sequence
  source: /note="Description of Artificial Sequence: Synthetic oligonucleotide"
auaucuguaaugguacuga

SEQ ID NO: 4978 - RNA, 19 nt, Artificial Sequence
  source: /note="Description of Artificial Sequence: Synthetic oligonucleotide"
uuuuaagucucucguagug

SEQ ID NO: 4979 - RNA, 19 nt, Artificial Sequence
  source: /note="Description of Artificial Sequence: Synthetic oligonucleotide"
uuuaagucucucguagugu

SEQ ID NO: 4980 - RNA, 19 nt, Artificial Sequence
  source: /note="Description of Artificial Sequence: Synthetic oligonucleotide"
agucucucguaguguuaag

SEQ ID NO: 4981 - RNA, 19 nt, Artificial Sequence
  source: /note="Description of Artificial Sequence: Synthetic oligonucleotide"
ucguaguguuaaguuauag

SEQ ID NO: 4982 - RNA, 19 nt, Artificial Sequence
  source: /note="Description of Artificial Sequence: Synthetic oligonucleotide"
cguaguguuaaguuauagu

SEQ ID NO: 4983 - RNA, 19 nt, Artificial Sequence
  source: /note="Description of Artificial Sequence: Synthetic oligonucleotide"
guaguguuaaguuauagug

SEQ ID NO: 4984 - RNA, 19 nt, Artificial Sequence
  source: /note="Description of Artificial Sequence: Synthetic oligonucleotide"
uaguguuaaguuauaguga

SEQ ID NO: 4985 - RNA, 19 nt, Artificial Sequence
  source: /note="Description of Artificial Sequence: Synthetic oligonucleotide"
uagugaauacugcuacagc

SEQ ID NO: 4986 - RNA, 19 nt, Artificial Sequence
  source: /note="Description of Artificial Sequence: Synthetic oligonucleotide"
aacacuaauucauaaucac

SEQ ID NO: 4987 - RNA, 19 nt, Artificial Sequence
  source: /note="Description of Artificial Sequence: Synthetic oligonucleotide"
acacuaauucauaaucacu

SEQ ID NO: 4988 - RNA, 19 nt, Artificial Sequence
  source: /note="Description of Artificial Sequence: Synthetic oligonucleotide"
uaauuguaaucugaauaaa

SEQ ID NO: 4989 - RNA, 19 nt, Artificial Sequence
  source: /note="Description of Artificial Sequence: Synthetic oligonucleotide"
auuguaaucugaauaaagu

SEQ ID NO: 4990 - RNA, 19 nt, Artificial Sequence
  source: /note="Description of Artificial Sequence: Synthetic oligonucleotide"
uuguaaucugaauaaagug

SEQ ID NO: 4991 - RNA, 19 nt, Artificial Sequence
  source: /note="Description of Artificial Sequence: Synthetic oligonucleotide"
uguaaucugaauaaagugu

SEQ ID NO: 4992 - RNA, 19 nt, Artificial Sequence
  source: /note="Description of Artificial Sequence: Synthetic oligonucleotide"
gacaaauagaaaauggucc

SEQ ID NO: 4993 - RNA, 19 nt, Artificial Sequence
  source: /note="Description of Artificial Sequence: Synthetic oligonucleotide"
acaaauagaaaauggucca

SEQ ID NO: 4994 - RNA, 19 nt, Artificial Sequence
  source: /note="Description of Artificial Sequence: Synthetic oligonucleotide"
uagaaaaugguccaauuag

SEQ ID NO: 4995 - RNA, 19 nt, Artificial Sequence
  source: /note="Description of Artificial Sequence: Synthetic oligonucleotide"
agaaaaugguccaauuagu

SEQ ID NO: 4996 - RNA, 19 nt, Artificial Sequence
  source: /note="Description of Artificial Sequence: Synthetic oligonucleotide"
uauuugggauauguauggg

SEQ ID NO: 4997 - RNA, 19 nt, Artificial Sequence
  source: /note="Description of Artificial Sequence: Synthetic oligonucleotide"
auuugggauauguaugggu

SEQ ID NO: 4998 - RNA, 19 nt, Artificial Sequence
  source: /note="Description of Artificial Sequence: Synthetic oligonucleotide"
uugggauauguauggguag

SEQ ID NO: 4999 - RNA, 19 nt, Artificial Sequence
  source: /note="Description of Artificial Sequence: Synthetic oligonucleotide"
ggauauguauggguagggu

SEQ ID NO: 5000 - RNA, 19 nt, Artificial Sequence
  source: /note="Description of Artificial Sequence: Synthetic oligonucleotide"
aagagguguuauuuggaac

SEQ ID NO: 5001 - RNA, 19 nt, Artificial Sequence
  source: /note="Description of Artificial Sequence: Synthetic oligonucleotide"
agagguguuauuuggaacc

SEQ ID NO: 5002 - RNA, 19 nt, Artificial Sequence
  source: /note="Description of Artificial Sequence: Synthetic oligonucleotide"
gagguguuauuuggaaccu

SEQ ID NO: 5003 - RNA, 19 nt, Artificial Sequence
  source: /note="Description of Artificial Sequence: Synthetic oligonucleotide"
uggaaccuuguuuuggaca

SEQ ID NO: 5004 - RNA, 19 nt, Artificial Sequence
  source: /note="Description of Artificial Sequence: Synthetic oligonucleotide"
ggaaccuuguuuuggacag

SEQ ID NO: 5005 - RNA, 19 nt, Artificial Sequence
  source: /note="Description of Artificial Sequence: Synthetic oligonucleotide"
gaaccuuguuuuggacagu

SEQ ID NO: 5006 - RNA, 19 nt, Artificial Sequence
  source: /note="Description of Artificial Sequence: Synthetic oligonucleotide"
guuuuggacaguuuaccag

SEQ ID NO: 5007 - RNA, 19 nt, Artificial Sequence
  source: /note="Description of Artificial Sequence: Synthetic oligonucleotide"
uuuuggacaguuuaccagu

SEQ ID NO: 5008 - RNA, 19 nt, Artificial Sequence
  source: /note="Description of Artificial Sequence: Synthetic oligonucleotide"
uuggacaguuuaccaguug

SEQ ID NO: 5009 - RNA, 19 nt, Artificial Sequence
  source: /note="Description of Artificial Sequence: Synthetic oligonucleotide"
guuguuguaaccugcugug

SEQ ID NO: 5010 - RNA, 19 nt, Artificial Sequence
  source: /note="Description of Artificial Sequence: Synthetic oligonucleotide"
uuguuguaaccugcuguga

SEQ ID NO: 5011 - RNA, 19 nt, Artificial Sequence
  source: /note="Description of Artificial Sequence: Synthetic oligonucleotide"
uuguaaccugcugugauac

SEQ ID NO: 5012 - RNA, 19 nt, Artificial Sequence
  source: /note="Description of Artificial Sequence: Synthetic oligonucleotide"
augcuucaagagaaaaugc

SEQ ID NO: 5013 - RNA, 19 nt, Artificial Sequence
  source: /note="Description of Artificial Sequence: Synthetic oligonucleotide"
agugaagaaugcacaagaa

SEQ ID NO: 5014 - RNA, 19 nt, Artificial Sequence
  source: /note="Description of Artificial Sequence: Synthetic oligonucleotide"
aauggaucacaagauggaa

SEQ ID NO: 5015 - RNA, 19 nt, Artificial Sequence
  source: /note="Description of Artificial Sequence: Synthetic oligonucleotide"
auggaucacaagauggaau

SEQ ID NO: 5016 - RNA, 19 nt, Artificial Sequence
  source: /note="Description of Artificial Sequence: Synthetic oligonucleotide"
uggaucacaagauggaauu

SEQ ID NO: 5017 - RNA, 19 nt, Artificial Sequence
  source: /note="Description of Artificial Sequence: Synthetic oligonucleotide"
ggaucacaagauggaauuu

SEQ ID NO: 5018 - RNA, 19 nt, Artificial Sequence
  source: /note="Description of Artificial Sequence: Synthetic oligonucleotide"
gaucacaagauggaauuua

SEQ ID NO: 5019 - RNA, 19 nt, Artificial Sequence
  source: /note="Description of Artificial Sequence: Synthetic oligonucleotide"
aucacaagauggaauuuau

SEQ ID NO: 5020 - RNA, 19 nt, Artificial Sequence
  source: /note="Description of Artificial Sequence: Synthetic oligonucleotide"
uggaauuuaucaaacccua

SEQ ID NO: 5021 - RNA, 19 nt, Artificial Sequence
  source: /note="Description of Artificial Sequence: Synthetic oligonucleotide"
acccuagccuugcuuguua

SEQ ID NO: 5022 - RNA, 19 nt, Artificial Sequence
  source: /note="Description of Artificial Sequence: Synthetic oligonucleotide"
cccuagccuugcuuguuaa

SEQ ID NO: 5023 - RNA, 19 nt, Artificial Sequence
  source: /note="Description of Artificial Sequence: Synthetic oligonucleotide"
ccuagccuugcuuguuaaa

SEQ ID NO: 5024 - RNA, 19 nt, Artificial Sequence
  source: /note="Description of Artificial Sequence: Synthetic oligonucleotide"
cuagccuugcuuguuaaau

SEQ ID NO: 5025 - RNA, 19 nt, Artificial Sequence
  source: /note="Description of Artificial Sequence: Synthetic oligonucleotide"
uagccuugcuuguuaaauu

SEQ ID NO: 5026 - RNA, 19 nt, Artificial Sequence
  source: /note="Description of Artificial Sequence: Synthetic oligonucleotide"
agccuugcuuguuaaauuu

SEQ ID NO: 5027 - RNA, 19 nt, Artificial Sequence
  source: /note="Description of Artificial Sequence: Synthetic oligonucleotide"
uuaagucucucguaguguu

SEQ ID NO: 5028 - RNA, 19 nt, Artificial Sequence
  source: /note="Description of Artificial Sequence: Synthetic oligonucleotide"
uaagucucucguaguguua

SEQ ID NO: 5029 - RNA, 19 nt, Artificial Sequence
  source: /note="Description of Artificial Sequence: Synthetic oligonucleotide"
aagucucucguaguguuaa

SEQ ID NO: 5030 - RNA, 19 nt, Artificial Sequence
  source: /note="Description of Artificial Sequence: Synthetic oligonucleotide"
cucguaguguuaaguuaua

SEQ ID NO: 5031 - RNA, 19 nt, Artificial Sequence
  source: /note="Description of Artificial Sequence: Synthetic oligonucleotide"
aguguuaaguuauagugaa

SEQ ID NO: 5032 - RNA, 19 nt, Artificial Sequence
  source: /note="Description of Artificial Sequence: Synthetic oligonucleotide"
guguuaaguuauagugaau

SEQ ID NO: 5033 - RNA, 19 nt, Artificial Sequence
  source: /note="Description of Artificial Sequence: Synthetic oligonucleotide"
cuacagcaauuucuaauuu

SEQ ID NO: 5034 - RNA, 19 nt, Artificial Sequence
  source: /note="Description of Artificial Sequence: Synthetic oligonucleotide"
caaauagaaaaugguccaa

SEQ ID NO: 5035 - RNA, 19 nt, Artificial Sequence
  source: /note="Description of Artificial Sequence: Synthetic oligonucleotide"
auagaaaaugguccaauua

SEQ ID NO: 5036 - RNA, 19 nt, Artificial Sequence
  source: /note="Description of Artificial Sequence: Synthetic oligonucleotide"
uuugggauauguaugggua

SEQ ID NO: 5037 - RNA, 19 nt, Artificial Sequence
  source: /note="Description of Artificial Sequence: Synthetic oligonucleotide"
gauauguauggguagggua

SEQ ID NO: 5038 - RNA, 19 nt, Artificial Sequence
  source: /note="Description of Artificial Sequence: Synthetic oligonucleotide"
uggguaggguaaaucagua

SEQ ID NO: 5039 - RNA, 19 nt, Artificial Sequence
  source: /note="Description of Artificial Sequence: Synthetic oligonucleotide"
uaagagguguuauuuggaa

SEQ ID NO: 5040 - RNA, 19 nt, Artificial Sequence
  source: /note="Description of Artificial Sequence: Synthetic oligonucleotide"
ugccuuuuaucccaaaguu

SEQ ID NO: 5041 - RNA, 19 nt, Artificial Sequence
  source: /note="Description of Artificial Sequence: Synthetic oligonucleotide"
uguuguaaccugcugugau

SEQ ID NO: 5042 - RNA, 19 nt, Artificial Sequence
  source: /note="Description of Artificial Sequence: Synthetic oligonucleotide"
guuguaaccugcugugaua

SEQ ID NO: 5043 - RNA, 19 nt, Artificial Sequence
  source: /note="Description of Artificial Sequence: Synthetic oligonucleotide"
caagagaaaaugcgguuau

SEQ ID NO: 5044 - RNA, 19 nt, Artificial Sequence
  source: /note="Description of Artificial Sequence: Synthetic oligonucleotide"
aagagaaaaugcgguuaua

SEQ ID NO: 5045 - RNA, 19 nt, Artificial Sequence
  source: /note="Description of Artificial Sequence: Synthetic oligonucleotide"
ccuguuccccugaggguau

SEQ ID NO: 5046 - RNA, 19 nt, Artificial Sequence
  source: /note="Description of Artificial Sequence: Synthetic oligonucleotide"
cuguuccccugaggguauu

SEQ ID NO: 5047 - RNA, 19 nt, Artificial Sequence
  source: /note="Description of Artificial Sequence: Synthetic oligonucleotide"
ccugaggguauuugaagua

SEQ ID NO: 5048 - RNA, 19 nt, Artificial Sequence
  source: /note="Description of Artificial Sequence: Synthetic oligonucleotide"
cugaggguauuugaaguau

SEQ ID NO: 5049 - RNA, 19 nt, Artificial Sequence
  source: /note="Description of Artificial Sequence: Synthetic oligonucleotide"
ugaggguauuugaaguaua

SEQ ID NO: 5050 - RNA, 19 nt, Artificial Sequence
  source: /note="Description of Artificial Sequence: Synthetic oligonucleotide"
gguauuugaaguauaccau

SEQ ID NO: 5051 - RNA, 19 nt, Artificial Sequence
  source: /note="Description of Artificial Sequence: Synthetic oligonucleotide"
guauuugaaguauaccaua

SEQ ID NO: 5052 - RNA, 19 nt, Artificial Sequence
  source: /note="Description of Artificial Sequence: Synthetic oligonucleotide"
uuugaaguauaccauacaa

SEQ ID NO: 5053 - RNA, 19 nt, Artificial Sequence
  source: /note="Description of Artificial Sequence: Synthetic oligonucleotide"
aguauaccauacaacuguu

SEQ ID NO: 5054 - RNA, 19 nt, Artificial Sequence
  source: /note="Description of Artificial Sequence: Synthetic oligonucleotide"
guauaccauacaacuguuu

SEQ ID NO: 5055 - RNA, 19 nt, Artificial Sequence
  source: /note="Description of Artificial Sequence: Synthetic oligonucleotide"
uauaccauacaacuguuuu

SEQ ID NO: 5056 - RNA, 19 nt, Artificial Sequence
  source: /note="Description of Artificial Sequence: Synthetic oligonucleotide"
accauacaacuguuuugaa

SEQ ID NO: 5057 - RNA, 19 nt, Artificial Sequence
  source: /note="Description of Artificial Sequence: Synthetic oligonucleotide"
ccauacaacuguuuugaaa

SEQ ID NO: 5058 - RNA, 19 nt, Artificial Sequence
  source: /note="Description of Artificial Sequence: Synthetic oligonucleotide"
gaaaauccagcguggacaa

SEQ ID NO: 5059 - RNA, 19 nt, Artificial Sequence
  source: /note="Description of Artificial Sequence: Synthetic oligonucleotide"
aaaauccagcguggacaau

SEQ ID NO: 5060 - RNA, 19 nt, Artificial Sequence
  source: /note="Description of Artificial Sequence: Synthetic oligonucleotide"
ccagcguggacaauggcua

SEQ ID NO: 5061 - RNA, 19 nt, Artificial Sequence
  source: /note="Description of Artificial Sequence: Synthetic oligonucleotide"
guggacaauggcuacucaa

SEQ ID NO: 5062 - RNA, 19 nt, Artificial Sequence
  source: /note="Description of Artificial Sequence: Synthetic oligonucleotide"
aauggcuacucaagcugau

SEQ ID NO: 5063 - RNA, 19 nt, Artificial Sequence
  source: /note="Description of Artificial Sequence: Synthetic oligonucleotide"
auggcuacucaagcugauu

SEQ ID NO: 5064 - RNA, 19 nt, Artificial Sequence
  source: /note="Description of Artificial Sequence: Synthetic oligonucleotide"
uggcuacucaagcugauuu

SEQ ID NO: 5065 - RNA, 19 nt, Artificial Sequence
  source: /note="Description of Artificial Sequence: Synthetic oligonucleotide"
cuacucaagcugauuugau

SEQ ID NO: 5066 - RNA, 19 nt, Artificial Sequence
  source: /note="Description of Artificial Sequence: Synthetic oligonucleotide"
auuugauggaguuggacau

SEQ ID NO: 5067 - RNA, 19 nt, Artificial Sequence
  source: /note="Description of Artificial Sequence: Synthetic oligonucleotide"
uggaguuggacauggccau

SEQ ID NO: 5068 - RNA, 19 nt, Artificial Sequence
  source: /note="Description of Artificial Sequence: Synthetic oligonucleotide"
guuggacauggccauggaa

SEQ ID NO: 5069 - RNA, 19 nt, Artificial Sequence
  source: /note="Description of Artificial Sequence: Synthetic oligonucleotide"
gccauggaaccagacagaa

SEQ ID NO: 5070 - RNA, 19 nt, Artificial Sequence
  source: /note="Description of Artificial Sequence: Synthetic oligonucleotide"
cauggaaccagacagaaaa

SEQ ID NO: 5071 - RNA, 19 nt, Artificial Sequence
  source: /note="Description of Artificial Sequence: Synthetic oligonucleotide"
ggaggcggagacggaggaa

SEQ ID NO: 5072 - RNA, 19 nt, Artificial Sequence
  source: /note="Description of Artificial Sequence: Synthetic oligonucleotide"
agacagaaaagcggcuguu

SEQ ID NO: 5073 - RNA, 19 nt, Artificial Sequence
  source: /note="Description of Artificial Sequence: Synthetic oligonucleotide"
gacagaaaagcggcuguua

SEQ ID NO: 5074 - RNA, 19 nt, Artificial Sequence
  source: /note="Description of Artificial Sequence: Synthetic oligonucleotide"
uguuagucacuggcagcaa

SEQ ID NO: 5075 - RNA, 19 nt, Artificial Sequence
  source: /note="Description of Artificial Sequence: Synthetic oligonucleotide"
cacuggcagcaacagucuu

SEQ ID NO: 5076 - RNA, 19 nt, Artificial Sequence
  source: /note="Description of Artificial Sequence: Synthetic oligonucleotide"
acuggcagcaacagucuua

SEQ ID NO: 5077 - RNA, 19 nt, Artificial Sequence
  source: /note="Description of Artificial Sequence: Synthetic oligonucleotide"
ucuuaccuggacucuggaa

SEQ ID NO: 5078 - RNA, 19 nt, Artificial Sequence
  source: /note="Description of Artificial Sequence: Synthetic oligonucleotide"
cuuaccuggacucuggaau

SEQ ID NO: 5079 - RNA, 19 nt, Artificial Sequence
  source: /note="Description of Artificial Sequence: Synthetic oligonucleotide"
ccuggacucuggaauccau

SEQ ID NO: 5080 - RNA, 19 nt, Artificial Sequence
  source: /note="Description of Artificial Sequence: Synthetic oligonucleotide"
ggcuagugguggaccccaa

SEQ ID NO: 5081 - RNA, 19 nt, Artificial Sequence
  source: /note="Description of Artificial Sequence: Synthetic oligonucleotide"
gccacuaccacagcuccuu

SEQ ID NO: 5082 - RNA, 19 nt, Artificial Sequence
  source: /note="Description of Artificial Sequence: Synthetic oligonucleotide"
uccuucucugagugguaaa

SEQ ID NO: 5083 - RNA, 19 nt, Artificial Sequence
  source: /note="Description of Artificial Sequence: Synthetic oligonucleotide"
cucugagugguaaaggcaa

SEQ ID NO: 5084 - RNA, 19 nt, Artificial Sequence
  source: /note="Description of Artificial Sequence: Synthetic oligonucleotide"
uaaaggcaauccugaggaa

SEQ ID NO: 5085 - RNA, 19 nt, Artificial Sequence
  source: /note="Description of Artificial Sequence: Synthetic oligonucleotide"
caauccugaggaagaggau

SEQ ID NO: 5086 - RNA, 19 nt, Artificial Sequence
  source: /note="Description of Artificial Sequence: Synthetic oligonucleotide"
ugaggaagaggauguggau

SEQ ID NO: 5087 - RNA, 19 nt, Artificial Sequence
  source: /note="Description of Artificial Sequence: Synthetic oligonucleotide"
auaccucccaaguccugua

SEQ ID NO: 5088 - RNA, 19 nt, Artificial Sequence
  source: /note="Description of Artificial Sequence: Synthetic oligonucleotide"
uaccucccaaguccuguau

SEQ ID NO: 5089 - RNA, 19 nt, Artificial Sequence
  source: /note="Description of Artificial Sequence: Synthetic oligonucleotide"
aguccuguaugagugggaa

SEQ ID NO: 5090 - RNA, 19 nt, Artificial Sequence
  source: /note="Description of Artificial Sequence: Synthetic oligonucleotide"
uaugagugggaacagggau

SEQ ID NO: 5091 - RNA, 19 nt, Artificial Sequence
  source: /note="Description of Artificial Sequence: Synthetic oligonucleotide"
caagcuuuaguaaauauaa

SEQ ID NO: 5092 - RNA, 19 nt, Artificial Sequence
  source: /note="Description of Artificial Sequence: Synthetic oligonucleotide"
aagcuuuaguaaauauaau

SEQ ID NO: 5093 - RNA, 19 nt, Artificial Sequence
  source: /note="Description of Artificial Sequence: Synthetic oligonucleotide"
ugagugggaacagggauuu

SEQ ID NO: 5094 - RNA, 19 nt, Artificial Sequence
  source: /note="Description of Artificial Sequence: Synthetic oligonucleotide"
gagugggaacagggauuuu

SEQ ID NO: 5095 - RNA, 19 nt, Artificial Sequence
  source: /note="Description of Artificial Sequence: Synthetic oligonucleotide"
agggauuuucucaguccuu

SEQ ID NO: 5096 - RNA, 19 nt, Artificial Sequence
  source: /note="Description of Artificial Sequence: Synthetic oligonucleotide"
uucucaguccuucacucaa

SEQ ID NO: 5097 - RNA, 19 nt, Artificial Sequence
  source: /note="Description of Artificial Sequence: Synthetic oligonucleotide"
ucaguccuucacucaagaa

SEQ ID NO: 5098 - RNA, 19 nt, Artificial Sequence
  source: /note="Description of Artificial Sequence: Synthetic oligonucleotide"
cuucacucaagaacaagua

SEQ ID NO: 5099 - RNA, 19 nt, Artificial Sequence
  source: /note="Description of Artificial Sequence: Synthetic oligonucleotide"
ucaagaacaaguagcugau

SEQ ID NO: 5100 - RNA, 19 nt, Artificial Sequence
  source: /note="Description of Artificial Sequence: Synthetic oligonucleotide"
cugauauugauggacagua

SEQ ID NO: 5101 - RNA, 19 nt, Artificial Sequence
  source: /note="Description of Artificial Sequence: Synthetic oligonucleotide"
auugauggacaguaugcaa

SEQ ID NO: 5102 - RNA, 19 nt, Artificial Sequence
  source: /note="Description of Artificial Sequence: Synthetic oligonucleotide"
gacucgagcucagagggua

SEQ ID NO: 5103 - RNA, 19 nt, Artificial Sequence
  source: /note="Description of Artificial Sequence: Synthetic oligonucleotide"
cagaggguacgagcugcua

SEQ ID NO: 5104 - RNA, 19 nt, Artificial Sequence
  source: /note="Description of Artificial Sequence: Synthetic oligonucleotide"
agaggguacgagcugcuau

SEQ ID NO: 5105 - RNA, 19 nt, Artificial Sequence
  source: /note="Description of Artificial Sequence: Synthetic oligonucleotide"
ggguacgagcugcuauguu

SEQ ID NO: 5106 - RNA, 19 nt, Artificial Sequence
  source: /note="Description of Artificial Sequence: Synthetic oligonucleotide"
cuauguucccugagacauu

SEQ ID NO: 5107 - RNA, 19 nt, Artificial Sequence
  source: /note="Description of Artificial Sequence: Synthetic oligonucleotide"
uauguucccugagacauua

SEQ ID NO: 5108 - RNA, 19 nt, Artificial Sequence
  source: /note="Description of Artificial Sequence: Synthetic oligonucleotide"
guucccugagacauuagau

SEQ ID NO: 5109 - RNA, 19 nt, Artificial Sequence
  source: /note="Description of Artificial Sequence: Synthetic oligonucleotide"
uagaugagggcaugcagau

SEQ ID NO: 5110 - RNA, 19 nt, Artificial Sequence
  source: /note="Description of Artificial Sequence: Synthetic oligonucleotide"
gagggcaugcagaucccau

SEQ ID NO: 5111 - RNA, 19 nt, Artificial Sequence
  source: /note="Description of Artificial Sequence: Synthetic oligonucleotide"
ggcaugcagaucccaucua

SEQ ID NO: 5112 - RNA, 19 nt, Artificial Sequence
  source: /note="Description of Artificial Sequence: Synthetic oligonucleotide"
agaucccaucuacacaguu

SEQ ID NO: 5113 - RNA, 19 nt, Artificial Sequence
  source: /note="Description of Artificial Sequence: Synthetic oligonucleotide"
cccaucuacacaguuugau

SEQ ID NO: 5114 - RNA, 19 nt, Artificial Sequence
  source: /note="Description of Artificial Sequence: Synthetic oligonucleotide"
acaguuugaugcugcucau

SEQ ID NO: 5115 - RNA, 19 nt, Artificial Sequence
  source: /note="Description of Artificial Sequence: Synthetic oligonucleotide"
gaugcugcucaucccacua

SEQ ID NO: 5116 - RNA, 19 nt, Artificial Sequence
  source: /note="Description of Artificial Sequence: Synthetic oligonucleotide"
augcugcucaucccacuaa

SEQ ID NO: 5117 - RNA, 19 nt, Artificial Sequence
  source: /note="Description of Artificial Sequence: Synthetic oligonucleotide"
ugcugcucaucccacuaau

SEQ ID NO: 5118 - RNA, 19 nt, Artificial Sequence
  source: /note="Description of Artificial Sequence: Synthetic oligonucleotide"
cccacuaauguccagcguu

SEQ ID NO: 5119 - RNA, 19 nt, Artificial Sequence
  source: /note="Description of Artificial Sequence: Synthetic oligonucleotide"
cagcguuuggcugaaccau

SEQ ID NO: 5120 - RNA, 19 nt, Artificial Sequence
  source: /note="Description of Artificial Sequence: Synthetic oligonucleotide"
uggcugaaccaucacagau

SEQ ID NO: 5121 - RNA, 19 nt, Artificial Sequence
  source: /note="Description of Artificial Sequence: Synthetic oligonucleotide"
aaccaucacagaugcugaa

SEQ ID NO: 5122 - RNA, 19 nt, Artificial Sequence
  source: /note="Description of Artificial Sequence: Synthetic oligonucleotide"
accaucacagaugcugaaa

SEQ ID NO: 5123 - RNA, 19 nt, Artificial Sequence
  source: /note="Description of Artificial Sequence: Synthetic oligonucleotide"
aucacagaugcugaaacau

SEQ ID NO: 5124 - RNA, 19 nt, Artificial Sequence
  source: /note="Description of Artificial Sequence: Synthetic oligonucleotide"
gaugcugaaacaugcaguu

SEQ ID NO: 5125 - RNA, 19 nt, Artificial Sequence
  source: /note="Description of Artificial Sequence: Synthetic oligonucleotide"
cugaaacaugcaguuguaa

SEQ ID NO: 5126 - RNA, 19 nt, Artificial Sequence
  source: /note="Description of Artificial Sequence: Synthetic oligonucleotide"
aacaugcaguuguaaacuu

SEQ ID NO: 5127 - RNA, 19 nt, Artificial Sequence
  source: /note="Description of Artificial Sequence: Synthetic oligonucleotide"
augcaguuguaaacuugau

SEQ ID NO: 5128 - RNA, 19 nt, Artificial Sequence
  source: /note="Description of Artificial Sequence: Synthetic oligonucleotide"
ugcaguuguaaacuugauu

SEQ ID NO: 5129 - RNA, 19 nt, Artificial Sequence
  source: /note="Description of Artificial Sequence: Synthetic oligonucleotide"
caguuguaaacuugauuaa

SEQ ID NO: 5130 - RNA, 19 nt, Artificial Sequence
  source: /note="Description of Artificial Sequence: Synthetic oligonucleotide"
cuugauuaacuaucaagau

SEQ ID NO: 5131 - RNA, 19 nt, Artificial Sequence
  source: /note="Description of Artificial Sequence: Synthetic oligonucleotide"
gauuaacuaucaagaugau

SEQ ID NO: 5132 - RNA, 19 nt, Artificial Sequence
  source: /note="Description of Artificial Sequence: Synthetic oligonucleotide"
cuaucaagaugaugcagaa

SEQ ID NO: 5133 - RNA, 19 nt, Artificial Sequence
  source: /note="Description of Artificial Sequence: Synthetic oligonucleotide"
gaacuugccacacgugcaa

SEQ ID NO: 5134 - RNA, 19 nt, Artificial Sequence
  source: /note="Description of Artificial Sequence: Synthetic oligonucleotide"
aacuugccacacgugcaau

SEQ ID NO: 5135 - RNA, 19 nt, Artificial Sequence
  source: /note="Description of Artificial Sequence: Synthetic oligonucleotide"
cacacgugcaaucccugaa

SEQ ID NO: 5136 - RNA, 19 nt, Artificial Sequence
  source: /note="Description of Artificial Sequence: Synthetic oligonucleotide"
gcaaucccugaacugacaa

SEQ ID NO: 5137 - RNA, 19 nt, Artificial Sequence
  source: /note="Description of Artificial Sequence: Synthetic oligonucleotide"
caaucccugaacugacaaa

SEQ ID NO: 5138 - RNA, 19 nt, Artificial Sequence
  source: /note="Description of Artificial Sequence: Synthetic oligonucleotide"
aaucccugaacugacaaaa

SEQ ID NO: 5139 - RNA, 19 nt, Artificial Sequence
  source: /note="Description of Artificial Sequence: Synthetic oligonucleotide"
ugaacugacaaaacugcua

SEQ ID NO: 5140 - RNA, 19 nt, Artificial Sequence
  source: /note="Description of Artificial Sequence: Synthetic oligonucleotide"
gaacugacaaaacugcuaa

SEQ ID NO: 5141 - RNA, 19 nt, Artificial Sequence
  source: /note="Description of Artificial Sequence: Synthetic oligonucleotide"
aacugacaaaacugcuaaa

SEQ ID NO: 5142 - RNA, 19 nt, Artificial Sequence
  source: /note="Description of Artificial Sequence: Synthetic oligonucleotide"
acugacaaaacugcuaaau

SEQ ID NO: 5143 - RNA, 19 nt, Artificial Sequence
  source: /note="Description of Artificial Sequence: Synthetic oligonucleotide"
gaggaccagguggugguua

SEQ ID NO: 5144 - RNA, 19 nt, Artificial Sequence
  source: /note="Description of Artificial Sequence: Synthetic oligonucleotide"
aggaccagguggugguuaa

SEQ ID NO: 5145 - RNA, 19 nt, Artificial Sequence
  source: /note="Description of Artificial Sequence: Synthetic oligonucleotide"
ggaccagguggugguuaau

SEQ ID NO: 5146 - RNA, 19 nt, Artificial Sequence
  source: /note="Description of Artificial Sequence: Synthetic oligonucleotide"
gaccagguggugguuaaua

SEQ ID NO: 5147 - RNA, 19 nt, Artificial Sequence
  source: /note="Description of Artificial Sequence: Synthetic oligonucleotide"
ucacuugcaauaauuauaa

SEQ ID NO: 5148 - RNA, 19 nt, Artificial Sequence
  source: /note="Description of Artificial Sequence: Synthetic oligonucleotide"
cuugcaauaauuauaagaa

SEQ ID NO: 5149 - RNA, 19 nt, Artificial Sequence
  source: /note="Description of Artificial Sequence: Synthetic oligonucleotide"
accagguggugguuaauaa

SEQ ID NO: 5150 - RNA, 19 nt, Artificial Sequence
  source: /note="Description of Artificial Sequence: Synthetic oligonucleotide"
ggcugcaguuaugguccau

SEQ ID NO: 5151 - RNA, 19 nt, Artificial Sequence
  source: /note="Description of Artificial Sequence: Synthetic oligonucleotide"
guuaugguccaucagcuuu

SEQ ID NO: 5152 - RNA, 19 nt, Artificial Sequence
  source: /note="Description of Artificial Sequence: Synthetic oligonucleotide"
augguccaucagcuuucua

SEQ ID NO: 5153 - RNA, 19 nt, Artificial Sequence
  source: /note="Description of Artificial Sequence: Synthetic oligonucleotide"
ugguccaucagcuuucuaa

SEQ ID NO: 5154 - RNA, 19 nt, Artificial Sequence
  source: /note="Description of Artificial Sequence: Synthetic oligonucleotide"
ucgggcuggugacagggaa

SEQ ID NO: 5155 - RNA, 19 nt, Artificial Sequence
  source: /note="Description of Artificial Sequence: Synthetic oligonucleotide"
gguccaucagcuuucuaaa

SEQ ID NO: 5156 - RNA, 19 nt, Artificial Sequence
  source: /note="Description of Artificial Sequence: Synthetic oligonucleotide"
guccaucagcuuucuaaaa

SEQ ID NO: 5157 - RNA, 19 nt, Artificial Sequence
  source: /note="Description of Artificial Sequence: Synthetic oligonucleotide"
gaagcuuccagacacgcua

SEQ ID NO: 5158 - RNA, 19 nt, Artificial Sequence
  source: /note="Description of Artificial Sequence: Synthetic oligonucleotide"
aagcuuccagacacgcuau

SEQ ID NO: 5159 - RNA, 19 nt, Artificial Sequence
  source: /note="Description of Artificial Sequence: Synthetic oligonucleotide"
cuuccagacacgcuaucau

SEQ ID NO: 5160 - RNA, 19 nt, Artificial Sequence
  source: /note="Description of Artificial Sequence: Synthetic oligonucleotide"
agacacgcuaucaugcguu

SEQ ID NO: 5161 - RNA, 19 nt, Artificial Sequence
  source: /note="Description of Artificial Sequence: Synthetic oligonucleotide"
ucaugcguucuccucagau

SEQ ID NO: 5162 - RNA, 19 nt, Artificial Sequence
  source: /note="Description of Artificial Sequence: Synthetic oligonucleotide"
ccucagauggugucugcua

SEQ ID NO: 5163 - RNA, 19 nt, Artificial Sequence
  source: /note="Description of Artificial Sequence: Synthetic oligonucleotide"
cucagauggugucugcuau

SEQ ID NO: 5164 - RNA, 19 nt, Artificial Sequence
  source: /note="Description of Artificial Sequence: Synthetic oligonucleotide"
gugucugcuauuguacgua

SEQ ID NO: 5165 - RNA, 19 nt, Artificial Sequence
  source: /note="Description of Artificial Sequence: Synthetic oligonucleotide"
cugcuauuguacguaccau

SEQ ID NO: 5166 - RNA, 19 nt, Artificial Sequence
  source: /note="Description of Artificial Sequence: Synthetic oligonucleotide"
uuguacguaccaugcagaa

SEQ ID NO: 5167 - RNA, 19 nt, Artificial Sequence
  source: /note="Description of Artificial Sequence: Synthetic oligonucleotide"
uguacguaccaugcagaau

SEQ ID NO: 5168 - RNA, 19 nt, Artificial Sequence
  source: /note="Description of Artificial Sequence: Synthetic oligonucleotide"
cguaccaugcagaauacaa

SEQ ID NO: 5169 - RNA, 19 nt, Artificial Sequence
  source: /note="Description of Artificial Sequence: Synthetic oligonucleotide"
caugcagaauacaaaugau

SEQ ID NO: 5170 - RNA, 19 nt, Artificial Sequence
  source: /note="Description of Artificial Sequence: Synthetic oligonucleotide"
gcagaauacaaaugaugua

SEQ ID NO: 5171 - RNA, 19 nt, Artificial Sequence
  source: /note="Description of Artificial Sequence: Synthetic oligonucleotide"
gaauacaaaugauguagaa

SEQ ID NO: 5172 - RNA, 19 nt, Artificial Sequence
  source: /note="Description of Artificial Sequence: Synthetic oligonucleotide"
gauguagaaacagcucguu

SEQ ID NO: 5173 - RNA, 19 nt, Artificial Sequence
  source: /note="Description of Artificial Sequence: Synthetic oligonucleotide"
guuguaccgcugggaccuu

SEQ ID NO: 5174 - RNA, 19 nt, Artificial Sequence
  source: /note="Description of Artificial Sequence: Synthetic oligonucleotide"
uaccgcugggaccuugcau

SEQ ID NO: 5175 - RNA, 19 nt, Artificial Sequence
  source: /note="Description of Artificial Sequence: Synthetic oligonucleotide"
ccgcugggaccuugcauaa

SEQ ID NO: 5176 - RNA, 19 nt, Artificial Sequence
  source: /note="Description of Artificial Sequence: Synthetic oligonucleotide"
ugggaccuugcauaaccuu

SEQ ID NO: 5177 - RNA, 19 nt, Artificial Sequence
  source: /note="Description of Artificial Sequence: Synthetic oligonucleotide"
gggaccuugcauaaccuuu

SEQ ID NO: 5178 - RNA, 19 nt, Artificial Sequence
  source: /note="Description of Artificial Sequence: Synthetic oligonucleotide"
cuugcauaaccuuucccau

SEQ ID NO: 5179 - RNA, 19 nt, Artificial Sequence
  source: /note="Description of Artificial Sequence: Synthetic oligonucleotide"
ucuuuaagucuggaggcau

SEQ ID NO: 5180 - RNA, 19 nt, Artificial Sequence
  source: /note="Description of Artificial Sequence: Synthetic oligonucleotide"
gcauuccugcccuggugaa

SEQ ID NO: 5181 - RNA, 19 nt, Artificial Sequence
  source: /note="Description of Artificial Sequence: Synthetic oligonucleotide"
cauuccugcccuggugaaa

SEQ ID NO: 5182 - RNA, 19 nt, Artificial Sequence
  source: /note="Description of Artificial Sequence: Synthetic oligonucleotide"
auuccugcccuggugaaaa

SEQ ID NO: 5183 - RNA, 19 nt, Artificial Sequence
  source: /note="Description of Artificial Sequence: Synthetic oligonucleotide"
uuccugcccuggugaaaau

SEQ ID NO: 5184 - RNA, 19 nt, Artificial Sequence
  source: /note="Description of Artificial Sequence: Synthetic oligonucleotide"
ugcccuggugaaaaugcuu

SEQ ID NO: 5185 - RNA, 19 nt, Artificial Sequence
  source: /note="Description of Artificial Sequence: Synthetic oligonucleotide"
cuggugaaaaugcuugguu

SEQ ID NO: 5186 - RNA, 19 nt, Artificial Sequence
  source: /note="Description of Artificial Sequence: Synthetic oligonucleotide"
gcuugguucaccaguggau

SEQ ID NO: 5187 - RNA, 19 nt, Artificial Sequence
  source: /note="Description of Artificial Sequence: Synthetic oligonucleotide"
cuugguucaccaguggauu

SEQ ID NO: 5188 - RNA, 19 nt, Artificial Sequence
  source: /note="Description of Artificial Sequence: Synthetic oligonucleotide"
ugcgugagcagggugccau

SEQ ID NO: 5189 - RNA, 19 nt, Artificial Sequence
  source: /note="Description of Artificial Sequence: Synthetic oligonucleotide"
gcgugagcagggugccauu

SEQ ID NO: 5190 - RNA, 19 nt, Artificial Sequence
  source: /note="Description of Artificial Sequence: Synthetic oligonucleotide"
caccaguggauucuguguu

SEQ ID NO: 5191 - RNA, 19 nt, Artificial Sequence
  source: /note="Description of Artificial Sequence: Synthetic oligonucleotide"
caguggauucuguguuguu

SEQ ID NO: 5192 - RNA, 19 nt, Artificial Sequence
  source: /note="Description of Artificial Sequence: Synthetic oligonucleotide"
aguggauucuguguuguuu

SEQ ID NO: 5193 - RNA, 19 nt, Artificial Sequence
  source: /note="Description of Artificial Sequence: Synthetic oligonucleotide"
guggauucuguguuguuuu

SEQ ID NO: 5194 - RNA, 19 nt, Artificial Sequence
  source: /note="Description of Artificial Sequence: Synthetic oligonucleotide"
uggauucuguguuguuuua

SEQ ID NO: 5195 - RNA, 19 nt, Artificial Sequence
  source: /note="Description of Artificial Sequence: Synthetic oligonucleotide"
ggauucuguguuguuuuau

SEQ ID NO: 5196 - RNA, 19 nt, Artificial Sequence
  source: /note="Description of Artificial Sequence: Synthetic oligonucleotide"
uguguuguuuuaugccauu

SEQ ID NO: 5197 - RNA, 19 nt, Artificial Sequence
  source: /note="Description of Artificial Sequence: Synthetic oligonucleotide"
gggugggacacagcagcaa

SEQ ID NO: 5198 - RNA, 19 nt, Artificial Sequence
  source: /note="Description of Artificial Sequence: Synthetic oligonucleotide"
guguuguuuuaugccauua

SEQ ID NO: 5199 - RNA, 19 nt, Artificial Sequence
  source: /note="Description of Artificial Sequence: Synthetic oligonucleotide"
uuguuuuaugccauuacaa

SEQ ID NO: 5200 - RNA, 19 nt, Artificial Sequence
  source: /note="Description of Artificial Sequence: Synthetic oligonucleotide"
ccauuacaacucuccacaa

SEQ ID NO: 5201 - RNA, 19 nt, Artificial Sequence
  source: /note="Description of Artificial Sequence: Synthetic oligonucleotide"
uacaacucuccacaaccuu

SEQ ID NO: 5202 - RNA, 19 nt, Artificial Sequence
  source: /note="Description of Artificial Sequence: Synthetic oligonucleotide"
acaacucuccacaaccuuu

SEQ ID NO: 5203 - RNA, 19 nt, Artificial Sequence
  source: /note="Description of Artificial Sequence: Synthetic oligonucleotide"
caacucuccacaaccuuuu

SEQ ID NO: 5204 - RNA, 19 nt, Artificial Sequence
  source: /note="Description of Artificial Sequence: Synthetic oligonucleotide"
aacucuccacaaccuuuua

SEQ ID NO: 5205 - RNA, 19 nt, Artificial Sequence
  source: /note="Description of Artificial Sequence: Synthetic oligonucleotide"
acucuccacaaccuuuuau

SEQ ID NO: 5206 - RNA, 19 nt, Artificial Sequence
  source: /note="Description of Artificial Sequence: Synthetic oligonucleotide"
cucuccacaaccuuuuauu

SEQ ID NO: 5207 - RNA, 19 nt, Artificial Sequence
  source: /note="Description of Artificial Sequence: Synthetic oligonucleotide"
ucuccacaaccuuuuauua

SEQ ID NO: 5208 - RNA, 19 nt, Artificial Sequence
  source: /note="Description of Artificial Sequence: Synthetic oligonucleotide"
caaccuuuuauuacaucaa

SEQ ID NO: 5209 - RNA, 19 nt, Artificial Sequence
  source: /note="Description of Artificial Sequence: Synthetic oligonucleotide"
ccuuuuauuacaucaagaa

SEQ ID NO: 5210 - RNA, 19 nt, Artificial Sequence
  source: /note="Description of Artificial Sequence: Synthetic oligonucleotide"
uuacaucaagaaggagcua

SEQ ID NO: 5211 - RNA, 19 nt, Artificial Sequence
  source: /note="Description of Artificial Sequence: Synthetic oligonucleotide"
uacaucaagaaggagcuaa

SEQ ID NO: 5212 - RNA, 19 nt, Artificial Sequence
  source: /note="Description of Artificial Sequence: Synthetic oligonucleotide"
caucaagaaggagcuaaaa

SEQ ID NO: 5213 - RNA, 19 nt, Artificial Sequence
  source: /note="Description of Artificial Sequence: Synthetic oligonucleotide"
aucaagaaggagcuaaaau

SEQ ID NO: 5214 - RNA, 19 nt, Artificial Sequence
  source: /note="Description of Artificial Sequence: Synthetic oligonucleotide"
gcuaaaauggcagugcguu

SEQ ID NO: 5215 - RNA, 19 nt, Artificial Sequence
  source: /note="Description of Artificial Sequence: Synthetic oligonucleotide"
uaaaauggcagugcguuua

SEQ ID NO: 5216 - RNA, 19 nt, Artificial Sequence
  source: /note="Description of Artificial Sequence: Synthetic oligonucleotide"
aaaugguugccuugcucaa

SEQ ID NO: 5217 - RNA, 19 nt, Artificial Sequence
  source: /note="Description of Artificial Sequence: Synthetic oligonucleotide"
gccuguuccccugagggua

SEQ ID NO: 5218 - RNA, 19 nt, Artificial Sequence
  source: /note="Description of Artificial Sequence: Synthetic oligonucleotide"
ugguugccuugcucaacaa

SEQ ID NO: 5219 - RNA, 19 nt, Artificial Sequence
  source: /note="Description of Artificial Sequence: Synthetic oligonucleotide"
gguugccuugcucaacaaa

SEQ ID NO: 5220 - RNA, 19 nt, Artificial Sequence
  source: /note="Description of Artificial Sequence: Synthetic oligonucleotide"
guugccuugcucaacaaaa

SEQ ID NO: 5221 - RNA, 19 nt, Artificial Sequence
  source: /note="Description of Artificial Sequence: Synthetic oligonucleotide"
gccuugcucaacaaaacaa

SEQ ID NO: 5222 - RNA, 19 nt, Artificial Sequence
  source: /note="Description of Artificial Sequence: Synthetic oligonucleotide"
ccuugcucaacaaaacaaa

SEQ ID NO: 5223 - RNA, 19 nt, Artificial Sequence
  source: /note="Description of Artificial Sequence: Synthetic oligonucleotide"
guuaaauucuuggcuauua

SEQ ID NO: 5224 - RNA, 19 nt, Artificial Sequence
  source: /note="Description of Artificial Sequence: Synthetic oligonucleotide"
uauuacgacagacugccuu

SEQ ID NO: 5225 - RNA, 19 nt, Artificial Sequence
  source: /note="Description of Artificial Sequence: Synthetic oligonucleotide"
auggcaaccaagaaagcaa

SEQ ID NO: 5226 - RNA, 19 nt, Artificial Sequence
  source: /note="Description of Artificial Sequence: Synthetic oligonucleotide"
agugguggaccccaagcuu

SEQ ID NO: 5227 - RNA, 19 nt, Artificial Sequence
  source: /note="Description of Artificial Sequence: Synthetic oligonucleotide"
gugguggaccccaagcuuu

SEQ ID NO: 5228 - RNA, 19 nt, Artificial Sequence
  source: /note="Description of Artificial Sequence: Synthetic oligonucleotide"
ugguggaccccaagcuuua

SEQ ID NO: 5229 - RNA, 19 nt, Artificial Sequence
  source: /note="Description of Artificial Sequence: Synthetic oligonucleotide"
uggaccccaagcuuuagua

SEQ ID NO: 5230 - RNA, 19 nt, Artificial Sequence
  source: /note="Description of Artificial Sequence: Synthetic oligonucleotide"
ggaccccaagcuuuaguaa

SEQ ID NO: 5231 - RNA, 19 nt, Artificial Sequence
  source: /note="Description of Artificial Sequence: Synthetic oligonucleotide"
gaccccaagcuuuaguaaa

SEQ ID NO: 5232 - RNA, 19 nt, Artificial Sequence
  source: /note="Description of Artificial Sequence: Synthetic oligonucleotide"
accccaagcuuuaguaaau

SEQ ID NO: 5233 - RNA, 19 nt, Artificial Sequence
  source: /note="Description of Artificial Sequence: Synthetic oligonucleotide"
ccccaagcuuuaguaaaua

SEQ ID NO: 5234 - RNA, 19 nt, Artificial Sequence
  source: /note="Description of Artificial Sequence: Synthetic oligonucleotide"
cccaagcuuuaguaaauau

SEQ ID NO: 5235 - RNA, 19 nt, Artificial Sequence
  source: /note="Description of Artificial Sequence: Synthetic oligonucleotide"
ccaagcuuuaguaaauaua

SEQ ID NO: 5236 - RNA, 19 nt, Artificial Sequence
  source: /note="Description of Artificial Sequence: Synthetic oligonucleotide"
uaaauauaaugaggaccua

SEQ ID NO: 5237 - RNA, 19 nt, Artificial Sequence
  source: /note="Description of Artificial Sequence: Synthetic oligonucleotide"
aaauauaaugaggaccuau

SEQ ID NO: 5238 - RNA, 19 nt, Artificial Sequence
  source: /note="Description of Artificial Sequence: Synthetic oligonucleotide"
aauauaaugaggaccuaua

SEQ ID NO: 5239 - RNA, 19 nt, Artificial Sequence
  source: /note="Description of Artificial Sequence: Synthetic oligonucleotide"
auaaugaggaccuauacuu

SEQ ID NO: 5240 - RNA, 19 nt, Artificial Sequence
  source: /note="Description of Artificial Sequence: Synthetic oligonucleotide"
aaacuacuguggaccacaa

SEQ ID NO: 5241 - RNA, 19 nt, Artificial Sequence
  source: /note="Description of Artificial Sequence: Synthetic oligonucleotide"
ccacaagcagagugcugaa

SEQ ID NO: 5242 - RNA, 19 nt, Artificial Sequence
  source: /note="Description of Artificial Sequence: Synthetic oligonucleotide"
cagagugcugaaggugcua

SEQ ID NO: 5243 - RNA, 19 nt, Artificial Sequence
  source: /note="Description of Artificial Sequence: Synthetic oligonucleotide"
agagugcugaaggugcuau

SEQ ID NO: 5244 - RNA, 19 nt, Artificial Sequence
  source: /note="Description of Artificial Sequence: Synthetic oligonucleotide"
auuguagaagcugguggaa

SEQ ID NO: 5245 - RNA, 19 nt, Artificial Sequence
  source: /note="Description of Artificial Sequence: Synthetic oligonucleotide"
uuguagaagcugguggaau

SEQ ID NO: 5246 - RNA, 19 nt, Artificial Sequence
  source: /note="Description of Artificial Sequence: Synthetic oligonucleotide"
gcugguggaaugcaagcuu

SEQ ID NO: 5247 - RNA, 19 nt, Artificial Sequence
  source: /note="Description of Artificial Sequence: Synthetic oligonucleotide"
cugguggaaugcaagcuuu

SEQ ID NO: 5248 - RNA, 19 nt, Artificial Sequence
  source: /note="Description of Artificial Sequence: Synthetic oligonucleotide"
aggacuucaccugacagau

SEQ ID NO: 5249 - RNA, 19 nt, Artificial Sequence
  source: /note="Description of Artificial Sequence: Synthetic oligonucleotide"
cuucaccugacagauccaa

SEQ ID NO: 5250 - RNA, 19 nt, Artificial Sequence
  source: /note="Description of Artificial Sequence: Synthetic oligonucleotide"
ccugacagauccaagucaa

SEQ ID NO: 5251 - RNA, 19 nt, Artificial Sequence
  source: /note="Description of Artificial Sequence: Synthetic oligonucleotide"
agauccaagucaacgucuu

SEQ ID NO: 5252 - RNA, 19 nt, Artificial Sequence
  source: /note="Description of Artificial Sequence: Synthetic oligonucleotide"
uccaagucaacgucuuguu

SEQ ID NO: 5253 - RNA, 19 nt, Artificial Sequence
  source: /note="Description of Artificial Sequence: Synthetic oligonucleotide"
ucuuguucagaacugucuu

SEQ ID NO: 5254 - RNA, 19 nt, Artificial Sequence
  source: /note="Description of Artificial Sequence: Synthetic oligonucleotide"
cuuguucagaacugucuuu

SEQ ID NO: 5255 - RNA, 19 nt, Artificial Sequence
  source: /note="Description of Artificial Sequence: Synthetic oligonucleotide"
gucuuuggacucucaggaa

SEQ ID NO: 5256 - RNA, 19 nt, Artificial Sequence
  source: /note="Description of Artificial Sequence: Synthetic oligonucleotide"
ucuuuggacucucaggaau

SEQ ID NO: 5257 - RNA, 19 nt, Artificial Sequence
  source: /note="Description of Artificial Sequence: Synthetic oligonucleotide"
uuggacucucaggaaucuu

SEQ ID NO: 5258 - RNA, 19 nt, Artificial Sequence
  source: /note="Description of Artificial Sequence: Synthetic oligonucleotide"
ugcccagggagaaccccuu

SEQ ID NO: 5259 - RNA, 19 nt, Artificial Sequence
  source: /note="Description of Artificial Sequence: Synthetic oligonucleotide"
uggacucucaggaaucuuu

SEQ ID NO: 5260 - RNA, 19 nt, Artificial Sequence
  source: /note="Description of Artificial Sequence: Synthetic oligonucleotide"
ucucaggaaucuuucagau

SEQ ID NO: 5261 - RNA, 19 nt, Artificial Sequence
  source: /note="Description of Artificial Sequence: Synthetic oligonucleotide"
aaucuuucagaugcugcaa

SEQ ID NO: 5262 - RNA, 19 nt, Artificial Sequence
  source: /note="Description of Artificial Sequence: Synthetic oligonucleotide"
cuuucagaugcugcaacua

SEQ ID NO: 5263 - RNA, 19 nt, Artificial Sequence
  source: /note="Description of Artificial Sequence: Synthetic oligonucleotide"
uucagaugcugcaacuaaa

SEQ ID NO: 5264 - RNA, 19 nt, Artificial Sequence
  source: /note="Description of Artificial Sequence: Synthetic oligonucleotide"
ugcugcaacuaaacaggaa

SEQ ID NO: 5265 - RNA, 19 nt, Artificial Sequence
  source: /note="Description of Artificial Sequence: Synthetic oligonucleotide"
uaaacaggaagggauggaa

SEQ ID NO: 5266 - RNA, 19 nt, Artificial Sequence
  source: /note="Description of Artificial Sequence: Synthetic oligonucleotide"
agggauggaaggucuccuu

SEQ ID NO: 5267 - RNA, 19 nt, Artificial Sequence
  source: /note="Description of Artificial Sequence: Synthetic oligonucleotide"
aggucuccuugggacucuu

SEQ ID NO: 5268 - RNA, 19 nt, Artificial Sequence
  source: /note="Description of Artificial Sequence: Synthetic oligonucleotide"
ucuccuugggacucuuguu

SEQ ID NO: 5269 - RNA, 19 nt, Artificial Sequence
  source: /note="Description of Artificial Sequence: Synthetic oligonucleotide"
ugggacucuuguucagcuu

SEQ ID NO: 5270 - RNA, 19 nt, Artificial Sequence
  source: /note="Description of Artificial Sequence: Synthetic oligonucleotide"
cuuguucagcuucuggguu

SEQ ID NO: 5271 - RNA, 19 nt, Artificial Sequence
  source: /note="Description of Artificial Sequence: Synthetic oligonucleotide"
ucagcuucuggguucagau

SEQ ID NO: 5272 - RNA, 19 nt, Artificial Sequence
  source: /note="Description of Artificial Sequence: Synthetic oligonucleotide"
gcuucuggguucagaugau

SEQ ID NO: 5273 - RNA, 19 nt, Artificial Sequence
  source: /note="Description of Artificial Sequence: Synthetic oligonucleotide"
cuucuggguucagaugaua

SEQ ID NO: 5274 - RNA, 19 nt, Artificial Sequence
  source: /note="Description of Artificial Sequence: Synthetic oligonucleotide"
ggccaggaugccuugggua

SEQ ID NO: 5275 - RNA, 19 nt, Artificial Sequence
  source: /note="Description of Artificial Sequence: Synthetic oligonucleotide"
uucuggguucagaugauau

SEQ ID NO: 5276 - RNA, 19 nt, Artificial Sequence
  source: /note="Description of Artificial Sequence: Synthetic oligonucleotide"
cuggguucagaugauauaa

SEQ ID NO: 5277 - RNA, 19 nt, Artificial Sequence
  source: /note="Description of Artificial Sequence: Synthetic oligonucleotide"
uggguucagaugauauaaa

SEQ ID NO: 5278 - RNA, 19 nt, Artificial Sequence
  source: /note="Description of Artificial Sequence: Synthetic oligonucleotide"
gucaccugugcagcuggaa

SEQ ID NO: 5279 - RNA, 19 nt, Artificial Sequence
  source: /note="Description of Artificial Sequence: Synthetic oligonucleotide"
ucaccugugcagcuggaau

SEQ ID NO: 5280 - RNA, 19 nt, Artificial Sequence
  source: /note="Description of Artificial Sequence: Synthetic oligonucleotide"
caccugugcagcuggaauu

SEQ ID NO: 5281 - RNA, 19 nt, Artificial Sequence
  source: /note="Description of Artificial Sequence: Synthetic oligonucleotide"
cugugcagcuggaauucuu

SEQ ID NO: 5282 - RNA, 19 nt, Artificial Sequence
  source: /note="Description of Artificial Sequence: Synthetic oligonucleotide"
ugugcagcuggaauucuuu

SEQ ID NO: 5283 - RNA, 19 nt, Artificial Sequence
  source: /note="Description of Artificial Sequence: Synthetic oligonucleotide"
gcagcuggaauucuuucua

SEQ ID NO: 5284 - RNA, 19 nt, Artificial Sequence
  source: /note="Description of Artificial Sequence: Synthetic oligonucleotide"
cagcuggaauucuuucuaa

SEQ ID NO: 5285 - RNA, 19 nt, Artificial Sequence
  source: /note="Description of Artificial Sequence: Synthetic oligonucleotide"
uuucuaaccucacuugcaa

SEQ ID NO: 5286 - RNA, 19 nt, Artificial Sequence
  source: /note="Description of Artificial Sequence: Synthetic oligonucleotide"
uucuaaccucacuugcaau

SEQ ID NO: 5287 - RNA, 19 nt, Artificial Sequence
  source: /note="Description of Artificial Sequence: Synthetic oligonucleotide"
accucacuugcaauaauua

SEQ ID NO: 5288 - RNA, 19 nt, Artificial Sequence
  source: /note="Description of Artificial Sequence: Synthetic oligonucleotide"
ccucacuugcaauaauuau

SEQ ID NO: 5289 - RNA, 19 nt, Artificial Sequence
  source: /note="Description of Artificial Sequence: Synthetic oligonucleotide"
cucacuugcaauaauuaua

SEQ ID NO: 5290 - RNA, 19 nt, Artificial Sequence
  source: /note="Description of Artificial Sequence: Synthetic oligonucleotide"
gucugccaaguggguggua

SEQ ID NO: 5291 - RNA, 19 nt, Artificial Sequence
  source: /note="Description of Artificial Sequence: Synthetic oligonucleotide"
ucugccaagugggugguau

SEQ ID NO: 5292 - RNA, 19 nt, Artificial Sequence
  source: /note="Description of Artificial Sequence: Synthetic oligonucleotide"
gggugguauagaggcucuu

SEQ ID NO: 5293 - RNA, 19 nt, Artificial Sequence
  source: /note="Description of Artificial Sequence: Synthetic oligonucleotide"
auagaggcucuugugcgua

SEQ ID NO: 5294 - RNA, 19 nt, Artificial Sequence
  source: /note="Description of Artificial Sequence: Synthetic oligonucleotide"
ucuugugcguacuguccuu

SEQ ID NO: 5295 - RNA, 19 nt, Artificial Sequence
  source: /note="Description of Artificial Sequence: Synthetic oligonucleotide"
cuggugacagggaagacau

SEQ ID NO: 5296 - RNA, 19 nt, Artificial Sequence
  source: /note="Description of Artificial Sequence: Synthetic oligonucleotide"
acaucacugagccugccau

SEQ ID NO: 5297 - RNA, 19 nt, Artificial Sequence
  source: /note="Description of Artificial Sequence: Synthetic oligonucleotide"
gccugccaucugugcucuu

SEQ ID NO: 5298 - RNA, 19 nt, Artificial Sequence
  source: /note="Description of Artificial Sequence: Synthetic oligonucleotide"
ucugaccagccgacaccaa

SEQ ID NO: 5299 - RNA, 19 nt, Artificial Sequence
  source: /note="Description of Artificial Sequence: Synthetic oligonucleotide"
gaccagccgacaccaagaa

SEQ ID NO: 5300 - RNA, 19 nt, Artificial Sequence
  source: /note="Description of Artificial Sequence: Synthetic oligonucleotide"
gacaccaagaagcagagau

SEQ ID NO: 5301 - RNA, 19 nt, Artificial Sequence
  source: /note="Description of Artificial Sequence: Synthetic oligonucleotide"
agcagagauggcccagaau

SEQ ID NO: 5302 - RNA, 19 nt, Artificial Sequence
  source: /note="Description of Artificial Sequence: Synthetic oligonucleotide"
gauggcccagaaugcaguu

SEQ ID NO: 5303 - RNA, 19 nt, Artificial Sequence
  source: /note="Description of Artificial Sequence: Synthetic oligonucleotide"
ccagaaugcaguucgccuu

SEQ ID NO: 5304 - RNA, 19 nt, Artificial Sequence
  source: /note="Description of Artificial Sequence: Synthetic oligonucleotide"
augcaguucgccuucacua

SEQ ID NO: 5305 - RNA, 19 nt, Artificial Sequence
  source: /note="Description of Artificial Sequence: Synthetic oligonucleotide"
ugcaguucgccuucacuau

SEQ ID NO: 5306 - RNA, 19 nt, Artificial Sequence
  source: /note="Description of Artificial Sequence: Synthetic oligonucleotide"
ucgccuucacuauggacua

SEQ ID NO: 5307 - RNA, 19 nt, Artificial Sequence
  source: /note="Description of Artificial Sequence: Synthetic oligonucleotide"
ucacuauggacuaccaguu

SEQ ID NO: 5308 - RNA, 19 nt, Artificial Sequence
  source: /note="Description of Artificial Sequence: Synthetic oligonucleotide"
uggacuaccaguugugguu

SEQ ID NO: 5309 - RNA, 19 nt, Artificial Sequence
  source: /note="Description of Artificial Sequence: Synthetic oligonucleotide"
ggacuaccaguugugguua

SEQ ID NO: 5310 - RNA, 19 nt, Artificial Sequence
  source: /note="Description of Artificial Sequence: Synthetic oligonucleotide"
gacuaccaguugugguuaa

SEQ ID NO: 5311 - RNA, 19 nt, Artificial Sequence
  source: /note="Description of Artificial Sequence: Synthetic oligonucleotide"
caguugugguuaagcucuu

SEQ ID NO: 5312 - RNA, 19 nt, Artificial Sequence
  source: /note="Description of Artificial Sequence: Synthetic oligonucleotide"
aguugugguuaagcucuua

SEQ ID NO: 5313 - RNA, 19 nt, Artificial Sequence
  source: /note="Description of Artificial Sequence: Synthetic oligonucleotide"
aagcucuuacacccaccau

SEQ ID NO: 5314 - RNA, 19 nt, Artificial Sequence
  source: /note="Description of Artificial Sequence: Synthetic oligonucleotide"
caucccacuggccucugau

SEQ ID NO: 5315 - RNA, 19 nt, Artificial Sequence
  source: /note="Description of Artificial Sequence: Synthetic oligonucleotide"
aucccacuggccucugaua

SEQ ID NO: 5316 - RNA, 19 nt, Artificial Sequence
  source: /note="Description of Artificial Sequence: Synthetic oligonucleotide"
ucccacuggccucugauaa

SEQ ID NO: 5317 - RNA, 19 nt, Artificial Sequence
  source: /note="Description of Artificial Sequence: Synthetic oligonucleotide"
uggccucugauaaaggcua

SEQ ID NO: 5318 - RNA, 19 nt, Artificial Sequence
  source: /note="Description of Artificial Sequence: Synthetic oligonucleotide"
ucugauaaaggcuacuguu

SEQ ID NO: 5319 - RNA, 19 nt, Artificial Sequence
  source: /note="Description of Artificial Sequence: Synthetic oligonucleotide"
auaaaggcuacuguuggau

SEQ ID NO: 5320 - RNA, 19 nt, Artificial Sequence
  source: /note="Description of Artificial Sequence: Synthetic oligonucleotide"
ggcuacuguuggauugauu

SEQ ID NO: 5321 - RNA, 19 nt, Artificial Sequence
  source: /note="Description of Artificial Sequence: Synthetic oligonucleotide"
uguuggauugauucgaaau

SEQ ID NO: 5322 - RNA, 19 nt, Artificial Sequence
  source: /note="Description of Artificial Sequence: Synthetic oligonucleotide"
ugccauuccacgacuaguu

SEQ ID NO: 5323 - RNA, 19 nt, Artificial Sequence
  source: /note="Description of Artificial Sequence: Synthetic oligonucleotide"
uuccacgacuaguucaguu

SEQ ID NO: 5324 - RNA, 19 nt, Artificial Sequence
  source: /note="Description of Artificial Sequence: Synthetic oligonucleotide"
acgacuaguucaguugcuu

SEQ ID NO: 5325 - RNA, 19 nt, Artificial Sequence
  source: /note="Description of Artificial Sequence: Synthetic oligonucleotide"
acuaguucaguugcuuguu

SEQ ID NO: 5326 - RNA, 19 nt, Artificial Sequence
  source: /note="Description of Artificial Sequence: Synthetic oligonucleotide"
guugcuuguucgugcacau

SEQ ID NO: 5327 - RNA, 19 nt, Artificial Sequence
  source: /note="Description of Artificial Sequence: Synthetic oligonucleotide"
uguucgugcacaucaggau

SEQ ID NO: 5328 - RNA, 19 nt, Artificial Sequence
  source: /note="Description of Artificial Sequence: Synthetic oligonucleotide"
guucgugcacaucaggaua

SEQ ID NO: 5329 - RNA, 19 nt, Artificial Sequence
  source: /note="Description of Artificial Sequence: Synthetic oligonucleotide"
ggugggacacagcagcaau

SEQ ID NO: 5330 - RNA, 19 nt, Artificial Sequence
  source: /note="Description of Artificial Sequence: Synthetic oligonucleotide"
gugggacacagcagcaauu

SEQ ID NO: 5331 - RNA, 19 nt, Artificial Sequence
  source: /note="Description of Artificial Sequence: Synthetic oligonucleotide"
ugggacacagcagcaauuu

SEQ ID NO: 5332 - RNA, 19 nt, Artificial Sequence
  source: /note="Description of Artificial Sequence: Synthetic oligonucleotide"
gggguccgcauggaagaaa

SEQ ID NO: 5333 - RNA, 19 nt, Artificial Sequence
  source: /note="Description of Artificial Sequence: Synthetic oligonucleotide"
ggguccgcauggaagaaau

SEQ ID NO: 5334 - RNA, 19 nt, Artificial Sequence
  source: /note="Description of Artificial Sequence: Synthetic oligonucleotide"
ucacauccuagcucgggau

SEQ ID NO: 5335 - RNA, 19 nt, Artificial Sequence
  source: /note="Description of Artificial Sequence: Synthetic oligonucleotide"
cauccuagcucgggauguu

SEQ ID NO: 5336 - RNA, 19 nt, Artificial Sequence
  source: /note="Description of Artificial Sequence: Synthetic oligonucleotide"
uagcucgggauguucacaa

SEQ ID NO: 5337 - RNA, 19 nt, Artificial Sequence
  source: /note="Description of Artificial Sequence: Synthetic oligonucleotide"
gggauguucacaaccgaau

SEQ ID NO: 5338 - RNA, 19 nt, Artificial Sequence
  source: /note="Description of Artificial Sequence: Synthetic oligonucleotide"
ggauguucacaaccgaauu

SEQ ID NO: 5339 - RNA, 19 nt, Artificial Sequence
  source: /note="Description of Artificial Sequence: Synthetic oligonucleotide"
cagaggacuaaauaccauu

SEQ ID NO: 5340 - RNA, 19 nt, Artificial Sequence
  source: /note="Description of Artificial Sequence: Synthetic oligonucleotide"
ggacuaaauaccauuccau

SEQ ID NO: 5341 - RNA, 19 nt, Artificial Sequence
  source: /note="Description of Artificial Sequence: Synthetic oligonucleotide"
uaaauaccauuccauuguu

SEQ ID NO: 5342 - RNA, 19 nt, Artificial Sequence
  source: /note="Description of Artificial Sequence: Synthetic oligonucleotide"
aaauaccauuccauuguuu

SEQ ID NO: 5343 - RNA, 19 nt, Artificial Sequence
  source: /note="Description of Artificial Sequence: Synthetic oligonucleotide"
auuguuugugcagcugcuu

SEQ ID NO: 5344 - RNA, 19 nt, Artificial Sequence
  source: /note="Description of Artificial Sequence: Synthetic oligonucleotide"
uuguuugugcagcugcuuu

SEQ ID NO: 5345 - RNA, 19 nt, Artificial Sequence
  source: /note="Description of Artificial Sequence: Synthetic oligonucleotide"
uguuugugcagcugcuuua

SEQ ID NO: 5346 - RNA, 19 nt, Artificial Sequence
  source: /note="Description of Artificial Sequence: Synthetic oligonucleotide"
guuugugcagcugcuuuau

SEQ ID NO: 5347 - RNA, 19 nt, Artificial Sequence
  source: /note="Description of Artificial Sequence: Synthetic oligonucleotide"
uuugugcagcugcuuuauu

SEQ ID NO: 5348 - RNA, 19 nt, Artificial Sequence
  source: /note="Description of Artificial Sequence: Synthetic oligonucleotide"
agcugcuuuauucucccau

SEQ ID NO: 5349 - RNA, 19 nt, Artificial Sequence
  source: /note="Description of Artificial Sequence: Synthetic oligonucleotide"
gcugcuuuauucucccauu

SEQ ID NO: 5350 - RNA, 19 nt, Artificial Sequence
  source: /note="Description of Artificial Sequence: Synthetic oligonucleotide"
uuuauucucccauugaaaa

SEQ ID NO: 5351 - RNA, 19 nt, Artificial Sequence
  source: /note="Description of Artificial Sequence: Synthetic oligonucleotide"
auucucccauugaaaacau

SEQ ID NO: 5352 - RNA, 19 nt, Artificial Sequence
  source: /note="Description of Artificial Sequence: Synthetic oligonucleotide"
ucccauugaaaacauccaa

SEQ ID NO: 5353 - RNA, 19 nt, Artificial Sequence
  source: /note="Description of Artificial Sequence: Synthetic oligonucleotide"
ugcagggguccucugugaa

SEQ ID NO: 5354 - RNA, 19 nt, Artificial Sequence
  source: /note="Description of Artificial Sequence: Synthetic oligonucleotide"
acuugcucaggacaaggaa

SEQ ID NO: 5355 - RNA, 19 nt, Artificial Sequence
  source: /note="Description of Artificial Sequence: Synthetic oligonucleotide"
cagcuccucugacagaguu

SEQ ID NO: 5356 - RNA, 19 nt, Artificial Sequence
  source: /note="Description of Artificial Sequence: Synthetic oligonucleotide"
agcuccucugacagaguua

SEQ ID NO: 5357 - RNA, 19 nt, Artificial Sequence
  source: /note="Description of Artificial Sequence: Synthetic oligonucleotide"
uccucugacagaguuacuu

SEQ ID NO: 5358 - RNA, 19 nt, Artificial Sequence
  source: /note="Description of Artificial Sequence: Synthetic oligonucleotide"
acagaguuacuucacucua

SEQ ID NO: 5359 - RNA, 19 nt, Artificial Sequence
  source: /note="Description of Artificial Sequence: Synthetic oligonucleotide"
aguuacuucacucuaggaa

SEQ ID NO: 5360 - RNA, 19 nt, Artificial Sequence
  source: /note="Description of Artificial Sequence: Synthetic oligonucleotide"
guuacuucacucuaggaau

SEQ ID NO: 5361 - RNA, 19 nt, Artificial Sequence
  source: /note="Description of Artificial Sequence: Synthetic oligonucleotide"
acuucacucuaggaaugaa

SEQ ID NO: 5362 - RNA, 19 nt, Artificial Sequence
  source: /note="Description of Artificial Sequence: Synthetic oligonucleotide"
gcugcuguuuuguuccgaa

SEQ ID NO: 5363 - RNA, 19 nt, Artificial Sequence
  source: /note="Description of Artificial Sequence: Synthetic oligonucleotide"
cugcuguuuuguuccgaau

SEQ ID NO: 5364 - RNA, 19 nt, Artificial Sequence
  source: /note="Description of Artificial Sequence: Synthetic oligonucleotide"
gucugaggacaagccacaa

SEQ ID NO: 5365 - RNA, 19 nt, Artificial Sequence
  source: /note="Description of Artificial Sequence: Synthetic oligonucleotide"
ugaggacaagccacaagau

SEQ ID NO: 5366 - RNA, 19 nt, Artificial Sequence
  source: /note="Description of Artificial Sequence: Synthetic oligonucleotide"
acaagccacaagauuacaa

SEQ ID NO: 5367 - RNA, 19 nt, Artificial Sequence
  source: /note="Description of Artificial Sequence: Synthetic oligonucleotide"
agccacaagauuacaagaa

SEQ ID NO: 5368 - RNA, 19 nt, Artificial Sequence
  source: /note="Description of Artificial Sequence: Synthetic oligonucleotide"
agauuacaagaaacggcuu

SEQ ID NO: 5369 - RNA, 19 nt, Artificial Sequence
  source: /note="Description of Artificial Sequence: Synthetic oligonucleotide"
caagaaacggcuuucaguu

SEQ ID NO: 5370 - RNA, 19 nt, Artificial Sequence
  source: /note="Description of Artificial Sequence: Synthetic oligonucleotide"
agcugaccagcucucucuu

SEQ ID NO: 5371 - RNA, 19 nt, Artificial Sequence
  source: /note="Description of Artificial Sequence: Synthetic oligonucleotide"
accagcucucucuucagaa

SEQ ID NO: 5372 - RNA, 19 nt, Artificial Sequence
  source: /note="Description of Artificial Sequence: Synthetic oligonucleotide"
uauuggugcccagggagaa

SEQ ID NO: 5373 - RNA, 19 nt, Artificial Sequence
  source: /note="Description of Artificial Sequence: Synthetic oligonucleotide"
cagggagaaccccuuggau

SEQ ID NO: 5374 - RNA, 19 nt, Artificial Sequence
  source: /note="Description of Artificial Sequence: Synthetic oligonucleotide"
agggagaaccccuuggaua

SEQ ID NO: 5375 - RNA, 19 nt, Artificial Sequence
  source: /note="Description of Artificial Sequence: Synthetic oligonucleotide"
ccuuggauaucgccaggau

SEQ ID NO: 5376 - RNA, 19 nt, Artificial Sequence
  source: /note="Description of Artificial Sequence: Synthetic oligonucleotide"
uaucgccaggaugauccua

SEQ ID NO: 5377 - RNA, 19 nt, Artificial Sequence
  source: /note="Description of Artificial Sequence: Synthetic oligonucleotide"
gccaggaugauccuagcua

SEQ ID NO: 5378 - RNA, 19 nt, Artificial Sequence
  source: /note="Description of Artificial Sequence: Synthetic oligonucleotide"
ccaggaugauccuagcuau

SEQ ID NO: 5379 - RNA, 19 nt, Artificial Sequence
  source: /note="Description of Artificial Sequence: Synthetic oligonucleotide"
gaugauccuagcuaucguu

SEQ ID NO: 5380 - RNA, 19 nt, Artificial Sequence
  source: /note="Description of Artificial Sequence: Synthetic oligonucleotide"
auccuagcuaucguucuuu

SEQ ID NO: 5381 - RNA, 19 nt, Artificial Sequence
  source: /note="Description of Artificial Sequence: Synthetic oligonucleotide"
uccuagcuaucguucuuuu

SEQ ID NO: 5382 - RNA, 19 nt, Artificial Sequence
  source: /note="Description of Artificial Sequence: Synthetic oligonucleotide"
ucuuuucacucugguggau

SEQ ID NO: 5383 - RNA, 19 nt, Artificial Sequence
  source: /note="Description of Artificial Sequence: Synthetic oligonucleotide"
cuuuucacucugguggaua

SEQ ID NO: 5384 - RNA, 19 nt, Artificial Sequence
  source: /note="Description of Artificial Sequence: Synthetic oligonucleotide"
uuuucacucugguggauau

SEQ ID NO: 5385 - RNA, 19 nt, Artificial Sequence
  source: /note="Description of Artificial Sequence: Synthetic oligonucleotide"
ugguggauauggccaggau

SEQ ID NO: 5386 - RNA, 19 nt, Artificial Sequence
  source: /note="Description of Artificial Sequence: Synthetic oligonucleotide"
gauauggccaggaugccuu

SEQ ID NO: 5387 - RNA, 19 nt, Artificial Sequence
  source: /note="Description of Artificial Sequence: Synthetic oligonucleotide"
ccuuggguauggaccccau

SEQ ID NO: 5388 - RNA, 19 nt, Artificial Sequence
  source: /note="Description of Artificial Sequence: Synthetic oligonucleotide"
uggguauggaccccaugau

SEQ ID NO: 5389 - RNA, 19 nt, Artificial Sequence
  source: /note="Description of Artificial Sequence: Synthetic oligonucleotide"
uuguaaacuugauuaacua

SEQ ID NO: 5390 - RNA, 19 nt, Artificial Sequence
  source: /note="Description of Artificial Sequence: Synthetic oligonucleotide"
uguaaacuugauuaacuau

SEQ ID NO: 5391 - RNA, 19 nt, Artificial Sequence
  source: /note="Description of Artificial Sequence: Synthetic oligonucleotide"
aaacuugauuaacuaucaa

SEQ ID NO: 5392 - RNA, 19 nt, Artificial Sequence
  source: /note="Description of Artificial Sequence: Synthetic oligonucleotide"
uauggaccccaugauggaa

SEQ ID NO: 5393 - RNA, 19 nt, Artificial Sequence
  source: /note="Description of Artificial Sequence: Synthetic oligonucleotide"
ggaccccaugauggaacau

SEQ ID NO: 5394 - RNA, 19 nt, Artificial Sequence
  source: /note="Description of Artificial Sequence: Synthetic oligonucleotide"
ccaugauggaacaugagau

SEQ ID NO: 5395 - RNA, 19 nt, Artificial Sequence
  source: /note="Description of Artificial Sequence: Synthetic oligonucleotide"
accacccuggugcugacua

SEQ ID NO: 5396 - RNA, 19 nt, Artificial Sequence
  source: /note="Description of Artificial Sequence: Synthetic oligonucleotide"
ccacccuggugcugacuau

SEQ ID NO: 5397 - RNA, 19 nt, Artificial Sequence
  source: /note="Description of Artificial Sequence: Synthetic oligonucleotide"
ugcugacuauccaguugau

SEQ ID NO: 5398 - RNA, 19 nt, Artificial Sequence
  source: /note="Description of Artificial Sequence: Synthetic oligonucleotide"
aguugaugggcugccagau

SEQ ID NO: 5399 - RNA, 19 nt, Artificial Sequence
  source: /note="Description of Artificial Sequence: Synthetic oligonucleotide"
ugcccaggaccucauggau

SEQ ID NO: 5400 - RNA, 19 nt, Artificial Sequence
  source: /note="Description of Artificial Sequence: Synthetic oligonucleotide"
gcaaucagcuggccugguu

SEQ ID NO: 5401 - RNA, 19 nt, Artificial Sequence
  source: /note="Description of Artificial Sequence: Synthetic oligonucleotide"
caaucagcuggccugguuu

SEQ ID NO: 5402 - RNA, 19 nt, Artificial Sequence
  source: /note="Description of Artificial Sequence: Synthetic oligonucleotide"
gguuugauacugaccugua

SEQ ID NO: 5403 - RNA, 19 nt, Artificial Sequence
  source: /note="Description of Artificial Sequence: Synthetic oligonucleotide"
auacugaccuguaaaucau

SEQ ID NO: 5404 - RNA, 19 nt, Artificial Sequence
  source: /note="Description of Artificial Sequence: Synthetic oligonucleotide"
ugaccuguaaaucauccuu

SEQ ID NO: 5405 - RNA, 19 nt, Artificial Sequence
  source: /note="Description of Artificial Sequence: Synthetic oligonucleotide"
gaccuguaaaucauccuuu

SEQ ID NO: 5406 - RNA, 19 nt, Artificial Sequence
  source: /note="Description of Artificial Sequence: Synthetic oligonucleotide"
accuguaaaucauccuuua

SEQ ID NO: 5407 - RNA, 19 nt, Artificial Sequence
  source: /note="Description of Artificial Sequence: Synthetic oligonucleotide"
aauacaaaugauguagaaa

SEQ ID NO: 5408 - RNA, 19 nt, Artificial Sequence
  source: /note="Description of Artificial Sequence: Synthetic oligonucleotide"
uuuuaagaauaucuguaau

SEQ ID NO: 5409 - RNA, 19 nt, Artificial Sequence
  source: /note="Description of Artificial Sequence: Synthetic oligonucleotide"
uacagcaauuucuaauuuu

SEQ ID NO: 5410 - RNA, 19 nt, Artificial Sequence
  source: /note="Description of Artificial Sequence: Synthetic oligonucleotide"
cacuaauucauaaucacuc

SEQ ID NO: 5411 - RNA, 19 nt, Artificial Sequence
  source: /note="Description of Artificial Sequence: Synthetic oligonucleotide"
acuaauucauaaucacucu

SEQ ID NO: 5412 - RNA, 19 nt, Artificial Sequence
  source: /note="Description of Artificial Sequence: Synthetic oligonucleotide"
uaauucauaaucacucuaa

SEQ ID NO: 5413 - RNA, 19 nt, Artificial Sequence
  source: /note="Description of Artificial Sequence: Synthetic oligonucleotide"
aauucauaaucacucuaau

SEQ ID NO: 5414 - RNA, 19 nt, Artificial Sequence
  source: /note="Description of Artificial Sequence: Synthetic oligonucleotide"
aauuguaaucugaauaaag

SEQ ID NO: 5415 - RNA, 19 nt, Artificial Sequence
  source: /note="Description of Artificial Sequence: Synthetic oligonucleotide"
uuuguauaaaauagacaaa

SEQ ID NO: 5416 - RNA, 19 nt, Artificial Sequence
  source: /note="Description of Artificial Sequence: Synthetic oligonucleotide"
uuguauaaaauagacaaau

SEQ ID NO: 5417 - RNA, 19 nt, Artificial Sequence
  source: /note="Description of Artificial Sequence: Synthetic oligonucleotide"
uguauaaaauagacaaaua

SEQ ID NO: 5418 - RNA, 19 nt, Artificial Sequence
  source: /note="Description of Artificial Sequence: Synthetic oligonucleotide"
guauaaaauagacaaauag

SEQ ID NO: 5419 - RNA, 19 nt, Artificial Sequence
  source: /note="Description of Artificial Sequence: Synthetic oligonucleotide"
auaaaauagacaaauagaa

SEQ ID NO: 5420 - RNA, 19 nt, Artificial Sequence
  source: /note="Description of Artificial Sequence: Synthetic oligonucleotide"
uaaaauagacaaauagaaa

SEQ ID NO: 5421 - RNA, 19 nt, Artificial Sequence
  source: /note="Description of Artificial Sequence: Synthetic oligonucleotide"
aaauagacaaauagaaaau

SEQ ID NO: 5422 - RNA, 19 nt, Artificial Sequence
  source: /note="Description of Artificial Sequence: Synthetic oligonucleotide"
ugggauauguauggguagg

SEQ ID NO: 5423 - RNA, 19 nt, Artificial Sequence
  source: /note="Description of Artificial Sequence: Synthetic oligonucleotide"
gggauauguauggguaggg

SEQ ID NO: 5424 - RNA, 19 nt, Artificial Sequence
  source: /note="Description of Artificial Sequence: Synthetic oligonucleotide"
cuaauucauaaucacucua

SEQ ID NO: 5425 - RNA, 19 nt, Artificial Sequence
  source: /note="Description of Artificial Sequence: Synthetic oligonucleotide"
aaauagaaaaugguccaau

SEQ ID NO: 5426 - RNA, 19 nt, Artificial Sequence
  source: /note="Description of Artificial Sequence: Synthetic oligonucleotide"
aauagaaaaugguccaauu

SEQ ID NO: 5427 - RNA, 19 nt, Artificial Sequence
  source: /note="Description of Artificial Sequence: Synthetic oligonucleotide"
uuuggacaguuuaccaguu

SEQ ID NO: 5428 - RNA, 19 nt, Artificial Sequence
  source: /note="Description of Artificial Sequence: Synthetic oligonucleotide"
auucuuucuaaccucacuu

SEQ ID NO: 5429 - RNA, 19 nt, Artificial Sequence
  source: /note="Description of Artificial Sequence: Synthetic oligonucleotide"
uggauugauucgaaaucuu

SEQ ID NO: 5430 - RNA, 19 nt, Artificial Sequence
  source: /note="Description of Artificial Sequence: Synthetic oligonucleotide"
aacuggauagucagcacca

SEQ ID NO: 5431 - RNA, 19 nt, Artificial Sequence
  source: /note="Description of Artificial Sequence: Synthetic oligonucleotide"
ugacgaagagcacagaugg

SEQ ID NO: 5432 - RNA, 19 nt, Artificial Sequence
  source: /note="Description of Artificial Sequence: Synthetic oligonucleotide"
aauagauccaccugcuuau

SEQ ID NO: 5433 - RNA, 19 nt, Artificial Sequence
  source: /note="Description of Artificial Sequence: Synthetic oligonucleotide"
cugcagcuacucuuuggau

SEQ ID NO: 5434 - RNA, 19 nt, Artificial Sequence
  source: /note="Description of Artificial Sequence: Synthetic oligonucleotide"
agcuugaguagccauuguc

SEQ ID NO: 5435 - RNA, 19 nt, Artificial Sequence
  source: /note="Description of Artificial Sequence: Synthetic oligonucleotide"
uuucgaaucaauccaacag

SEQ ID NO: 5436 - RNA, 19 nt, Artificial Sequence
  source: /note="Description of Artificial Sequence: Synthetic oligonucleotide"
aguaucaaaccaggccagc

SEQ ID NO: 5437 - RNA, 19 nt, Artificial Sequence
  source: /note="Description of Artificial Sequence: Synthetic oligonucleotide"
uauugcaagugagguuaga

SEQ ID NO: 5438 - RNA, 19 nt, Artificial Sequence
  source: /note="Description of Artificial Sequence: Synthetic oligonucleotide"
ggaucauccuggcgauauc

SEQ ID NO: 5439 - RNA, 19 nt, Artificial Sequence
  source: /note="Description of Artificial Sequence: Synthetic oligonucleotide"
ccagacuuaaagauggcca

SEQ ID NO: 5440 - RNA, 19 nt, Artificial Sequence
  source: /note="Description of Artificial Sequence: Synthetic oligonucleotide"
uaugaauuaguguucuaca

SEQ ID NO: 5441 - RNA, 19 nt, Artificial Sequence
  source: /note="Description of Artificial Sequence: Synthetic oligonucleotide"
aauaacaccucuuacugau

SEQ ID NO: 5442 - RNA, 19 nt, Artificial Sequence
  source: /note="Description of Artificial Sequence: Synthetic oligonucleotide"
gucagaugacgaagagcac

SEQ ID NO: 5443 - RNA, 19 nt, Artificial Sequence
  source: /note="Description of Artificial Sequence: Synthetic oligonucleotide"
acaggucaguaucaaacca

SEQ ID NO: 5444 - RNA, 19 nt, Artificial Sequence
  source: /note="Description of Artificial Sequence: Synthetic oligonucleotide"
ugggauaaaaggcaacugg

SEQ ID NO: 5445 - RNA, 19 nt, Artificial Sequence
  source: /note="Description of Artificial Sequence: Synthetic oligonucleotide"
aggucaguaucaaaccagg

SEQ ID NO: 5446 - RNA, 19 nt, Artificial Sequence
  source: /note="Description of Artificial Sequence: Synthetic oligonucleotide"
gcccaucaacuggauaguc

SEQ ID NO: 5447 - RNA, 19 nt, Artificial Sequence
  source: /note="Description of Artificial Sequence: Synthetic oligonucleotide"
ucauuccaagccauuggcu

SEQ ID NO: 5448 - RNA, 19 nt, Artificial Sequence
  source: /note="Description of Artificial Sequence: Synthetic oligonucleotide"
cucauuccaagccauuggc

SEQ ID NO: 5449 - RNA, 19 nt, Artificial Sequence
  source: /note="Description of Artificial Sequence: Synthetic oligonucleotide"
gaucugcaugcccucaucu

SEQ ID NO: 5450 - RNA, 19 nt, Artificial Sequence
  source: /note="Description of Artificial Sequence: Synthetic oligonucleotide"
agcaaguucacagaggacc

SEQ ID NO: 5451 - RNA, 19 nt, Artificial Sequence
  source: /note="Description of Artificial Sequence: Synthetic oligonucleotide"
aacaagcaaggcuaggguu

SEQ ID NO: 5452 - RNA, 19 nt, Artificial Sequence
  source: /note="Description of Artificial Sequence: Synthetic oligonucleotide"
ugauuaugaauuaguguuc

SEQ ID NO: 5453 - RNA, 19 nt, Artificial Sequence
  source: /note="Description of Artificial Sequence: Synthetic oligonucleotide"
agcaaggcuaggguuugau

SEQ ID NO: 5454 - RNA, 19 nt, Artificial Sequence
  source: /note="Description of Artificial Sequence: Synthetic oligonucleotide"
gggauaaaaggcaacuggu

SEQ ID NO: 5455 - RNA, 19 nt, Artificial Sequence
  source: /note="Description of Artificial Sequence: Synthetic oligonucleotide"
uuauugcaagugagguuag

SEQ ID NO: 5456 - RNA, 19 nt, Artificial Sequence
  source: /note="Description of Artificial Sequence: Synthetic oligonucleotide"
cgcuggacauuagugggau

SEQ ID NO: 5457 - RNA, 19 nt, Artificial Sequence
  source: /note="Description of Artificial Sequence: Synthetic oligonucleotide"
ccaucaacuggauagucag

SEQ ID NO: 5458 - RNA, 19 nt, Artificial Sequence
  source: /note="Description of Artificial Sequence: Synthetic oligonucleotide"
gucaguaucaaaccaggcc

SEQ ID NO: 5459 - RNA, 19 nt, Artificial Sequence
  source: /note="Description of Artificial Sequence: Synthetic oligonucleotide"
caccucuuacugauuuacc

SEQ ID NO: 5460 - RNA, 19 nt, Artificial Sequence
  source: /note="Description of Artificial Sequence: Synthetic oligonucleotide"
ggucaguaucaaaccaggc

SEQ ID NO: 5461 - RNA, 19 nt, Artificial Sequence
  source: /note="Description of Artificial Sequence: Synthetic oligonucleotide"
aguucacagaggaccccug

SEQ ID NO: 5462 - RNA, 19 nt, Artificial Sequence
  source: /note="Description of Artificial Sequence: Synthetic oligonucleotide"
gcaccagaauggauuccag

SEQ ID NO: 5463 - RNA, 19 nt, Artificial Sequence
  source: /note="Description of Artificial Sequence: Synthetic oligonucleotide"
gugguggccacccaucuca

SEQ ID NO: 5464 - RNA, 19 nt, Artificial Sequence
  source: /note="Description of Artificial Sequence: Synthetic oligonucleotide"
ugaccacauuuauaucauc

SEQ ID NO: 5465 - RNA, 19 nt, Artificial Sequence
  source: /note="Description of Artificial Sequence: Synthetic oligonucleotide"
ucaaugggagaauaaagca

SEQ ID NO: 5466 - RNA, 19 nt, Artificial Sequence
  source: /note="Description of Artificial Sequence: Synthetic oligonucleotide"
caaggcuaggguuugauaa

SEQ ID NO: 5467 - RNA, 19 nt, Artificial Sequence
  source: /note="Description of Artificial Sequence: Synthetic oligonucleotide"
cuuuaucagaggccagugg

SEQ ID NO: 5468 - RNA, 19 nt, Artificial Sequence
  source: /note="Description of Artificial Sequence: Synthetic oligonucleotide"
auugcacguguggcaaguu

SEQ ID NO: 5469 - RNA, 19 nt, Artificial Sequence
  source: /note="Description of Artificial Sequence: Synthetic oligonucleotide"
uggucagaugacgaagagc

SEQ ID NO: 5470 - RNA, 19 nt, Artificial Sequence
  source: /note="Description of Artificial Sequence: Synthetic oligonucleotide"
aauccauuuguauuguuac

SEQ ID NO: 5471 - RNA, 19 nt, Artificial Sequence
  source: /note="Description of Artificial Sequence: Synthetic oligonucleotide"
caaguucacagaggacccc

SEQ ID NO: 5472 - RNA, 19 nt, Artificial Sequence
  source: /note="Description of Artificial Sequence: Synthetic oligonucleotide"
caagcaaggcuaggguuug

SEQ ID NO: 5473 - RNA, 19 nt, Artificial Sequence
  source: /note="Description of Artificial Sequence: Synthetic oligonucleotide"
guguucuacaccauuacuc

SEQ ID NO: 5474 - RNA, 19 nt, Artificial Sequence
  source: /note="Description of Artificial Sequence: Synthetic oligonucleotide"
aggcucagugaugucuucc

SEQ ID NO: 5475 - RNA, 19 nt, Artificial Sequence
  source: /note="Description of Artificial Sequence: Synthetic oligonucleotide"
ggcucagugaugucuuccc

SEQ ID NO: 5476 - RNA, 19 nt, Artificial Sequence
  source: /note="Description of Artificial Sequence: Synthetic oligonucleotide"
ugaauuaguguucuacacc

SEQ ID NO: 5477 - RNA, 19 nt, Artificial Sequence
  source: /note="Description of Artificial Sequence: Synthetic oligonucleotide"
ggauaaaaggcaacuggua

SEQ ID NO: 5478 - RNA, 19 nt, Artificial Sequence
  source: /note="Description of Artificial Sequence: Synthetic oligonucleotide"
gaucauccuggcgauaucc

SEQ ID NO: 5479 - RNA, 19 nt, Artificial Sequence
  source: /note="Description of Artificial Sequence: Synthetic oligonucleotide"
acaagcaaggcuaggguuu

SEQ ID NO: 5480 - RNA, 19 nt, Artificial Sequence
  source: /note="Description of Artificial Sequence: Synthetic oligonucleotide"
cuggucagaugacgaagag

SEQ ID NO: 5481 - RNA, 19 nt, Artificial Sequence
  source: /note="Description of Artificial Sequence: Synthetic oligonucleotide"
cccaucaacuggauaguca

SEQ ID NO: 5482 - RNA, 19 nt, Artificial Sequence
  source: /note="Description of Artificial Sequence: Synthetic oligonucleotide"
ccuucagcacucugcuugu

SEQ ID NO: 5483 - RNA, 19 nt, Artificial Sequence
  source: /note="Description of Artificial Sequence: Synthetic oligonucleotide"
augacgaagagcacagaug

SEQ ID NO: 5484 - RNA, 19 nt, Artificial Sequence
  source: /note="Description of Artificial Sequence: Synthetic oligonucleotide"
gucucauuccaagccauug

SEQ ID NO: 5485 - RNA, 19 nt, Artificial Sequence
  source: /note="Description of Artificial Sequence: Synthetic oligonucleotide"
gccuuuaucagaggccagu

SEQ ID NO: 5486 - RNA, 19 nt, Artificial Sequence
  source: /note="Description of Artificial Sequence: Synthetic oligonucleotide"
cuggacauuagugggauga

SEQ ID NO: 5487 - RNA, 19 nt, Artificial Sequence
  source: /note="Description of Artificial Sequence: Synthetic oligonucleotide"
ugucuggaagcuuccuuuu

SEQ ID NO: 5488 - RNA, 19 nt, Artificial Sequence
  source: /note="Description of Artificial Sequence: Synthetic oligonucleotide"
caccagagugaaaagaacg

SEQ ID NO: 5489 - RNA, 19 nt, Artificial Sequence
  source: /note="Description of Artificial Sequence: Synthetic oligonucleotide"
agcagguuacaacaacuuu

SEQ ID NO: 5490 - RNA, 19 nt, Artificial Sequence
  source: /note="Description of Artificial Sequence: Synthetic oligonucleotide"
cagcuugaguagccauugu

SEQ ID NO: 5491 - RNA, 19 nt, Artificial Sequence
  source: /note="Description of Artificial Sequence: Synthetic oligonucleotide"
uggacauuagugggaugag

SEQ ID NO: 5492 - RNA, 19 nt, Artificial Sequence
  source: /note="Description of Artificial Sequence: Synthetic oligonucleotide"
aaguucacagaggaccccu

SEQ ID NO: 5493 - RNA, 19 nt, Artificial Sequence
  source: /note="Description of Artificial Sequence: Synthetic oligonucleotide"
gaaauagauccaccugcuu

SEQ ID NO: 5494 - RNA, 19 nt, Artificial Sequence
  source: /note="Description of Artificial Sequence: Synthetic oligonucleotide"
cagcagguuacaacaacuu

SEQ ID NO: 5495 - RNA, 19 nt, Artificial Sequence
  source: /note="Description of Artificial Sequence: Synthetic oligonucleotide"
ugaaauagauccaccugcu

SEQ ID NO: 5496 - RNA, 19 nt, Artificial Sequence
  source: /note="Description of Artificial Sequence: Synthetic oligonucleotide"
gaugggaucugcaugcccu

SEQ ID NO: 5497 - RNA, 19 nt, Artificial Sequence
  source: /note="Description of Artificial Sequence: Synthetic oligonucleotide"
guuuaauucugaaccauuu

SEQ ID NO: 5498 - RNA, 19 nt, Artificial Sequence
  source: /note="Description of Artificial Sequence: Synthetic oligonucleotide"
cuuguccugagcaaguuca

SEQ ID NO: 5499 - RNA, 19 nt, Artificial Sequence
  source: /note="Description of Artificial Sequence: Synthetic oligonucleotide"
gaccccugcagcuacucuu

SEQ ID NO: 5500 - RNA, 19 nt, Artificial Sequence
  source: /note="Description of Artificial Sequence: Synthetic oligonucleotide"
uuuaucagaggccaguggg

SEQ ID NO: 5501 - RNA, 19 nt, Artificial Sequence
  source: /note="Description of Artificial Sequence: Synthetic oligonucleotide"
caguaucaaaccaggccag

SEQ ID NO: 5502 - RNA, 19 nt, Artificial Sequence
  source: /note="Description of Artificial Sequence: Synthetic oligonucleotide"
auuuacaggucaguaucaa

SEQ ID NO: 5503 - RNA, 19 nt, Artificial Sequence
  source: /note="Description of Artificial Sequence: Synthetic oligonucleotide"
augaauuaguguucuacac

SEQ ID NO: 5504 - RNA, 19 nt, Artificial Sequence
  source: /note="Description of Artificial Sequence: Synthetic oligonucleotide"
agcccaucaacuggauagu

SEQ ID NO: 5505 - RNA, 19 nt, Artificial Sequence
  source: /note="Description of Artificial Sequence: Synthetic oligonucleotide"
uaacaccucuuacugauuu

SEQ ID NO: 5506 - RNA, 19 nt, Artificial Sequence
  source: /note="Description of Artificial Sequence: Synthetic oligonucleotide"
augaaauagauccaccugc

SEQ ID NO: 5507 - RNA, 19 nt, Artificial Sequence
  source: /note="Description of Artificial Sequence: Synthetic oligonucleotide"
acuggauagucagcaccag

SEQ ID NO: 5508 - RNA, 19 nt, Artificial Sequence
  source: /note="Description of Artificial Sequence: Synthetic oligonucleotide"
uuguccugagcaaguucac

SEQ ID NO: 5509 - RNA, 19 nt, Artificial Sequence
  source: /note="Description of Artificial Sequence: Synthetic oligonucleotide"
aaauaacaccucuuacuga

SEQ ID NO: 5510 - RNA, 19 nt, Artificial Sequence
  source: /note="Description of Artificial Sequence: Synthetic oligonucleotide"
cugagcaaguucacagagg

SEQ ID NO: 5511 - RNA, 19 nt, Artificial Sequence
  source: /note="Description of Artificial Sequence: Synthetic oligonucleotide"
ucugugaugguucagccaa

SEQ ID NO: 5512 - RNA, 19 nt, Artificial Sequence
  source: /note="Description of Artificial Sequence: Synthetic oligonucleotide"
aucaaaccaggccagcuga

SEQ ID NO: 5513 - RNA, 19 nt, Artificial Sequence
  source: /note="Description of Artificial Sequence: Synthetic oligonucleotide"
agaggaccccugcagcuac

SEQ ID NO: 5514 - RNA, 19 nt, Artificial Sequence
  source: /note="Description of Artificial Sequence: Synthetic oligonucleotide"
cacugccauuuuagcuccu

SEQ ID NO: 5515 - RNA, 19 nt, Artificial Sequence
  source: /note="Description of Artificial Sequence: Synthetic oligonucleotide"
cagucucauuccaagccau

SEQ ID NO: 5516 - RNA, 19 nt, Artificial Sequence
  source: /note="Description of Artificial Sequence: Synthetic oligonucleotide"
ucauccuggcgauauccaa

SEQ ID NO: 5517 - RNA, 19 nt, Artificial Sequence
  source: /note="Description of Artificial Sequence: Synthetic oligonucleotide"
aaaaguuuaauucugaacc

SEQ ID NO: 5518 - RNA, 19 nt, Artificial Sequence
  source: /note="Description of Artificial Sequence: Synthetic oligonucleotide"
accucuuacugauuuaccc

SEQ ID NO: 5519 - RNA, 19 nt, Artificial Sequence
  source: /note="Description of Artificial Sequence: Synthetic oligonucleotide"
acaaacaauggaaugguau

SEQ ID NO: 5520 - RNA, 19 nt, Artificial Sequence
  source: /note="Description of Artificial Sequence: Synthetic oligonucleotide"
uucgaaucaauccaacagu

SEQ ID NO: 5521 - RNA, 19 nt, Artificial Sequence
  source: /note="Description of Artificial Sequence: Synthetic oligonucleotide"
uccuuguccugagcaaguu

SEQ ID NO: 5522 - RNA, 19 nt, Artificial Sequence
  source: /note="Description of Artificial Sequence: Synthetic oligonucleotide"
accugcuuauuuuaagcau

SEQ ID NO: 5523 - RNA, 19 nt, Artificial Sequence
  source: /note="Description of Artificial Sequence: Synthetic oligonucleotide"
uuacaggucaguaucaaac

SEQ ID NO: 5524 - RNA, 19 nt, Artificial Sequence
  source: /note="Description of Artificial Sequence: Synthetic oligonucleotide"
aguuuaauucugaaccauu

SEQ ID NO: 5525 - RNA, 19 nt, Artificial Sequence
  source: /note="Description of Artificial Sequence: Synthetic oligonucleotide"
uuacaacaacuuugggaua

SEQ ID NO: 5526 - RNA, 19 nt, Artificial Sequence
  source: /note="Description of Artificial Sequence: Synthetic oligonucleotide"
ucaaaccaggccagcugau

SEQ ID NO: 5527 - RNA, 19 nt, Artificial Sequence
  source: /note="Description of Artificial Sequence: Synthetic oligonucleotide"
gaagagcacagauggcagg

SEQ ID NO: 5528 - RNA, 19 nt, Artificial Sequence
  source: /note="Description of Artificial Sequence: Synthetic oligonucleotide"
uacaucauuuguauucugc

SEQ ID NO: 5529 - RNA, 19 nt, Artificial Sequence
  source: /note="Description of Artificial Sequence: Synthetic oligonucleotide"
ccugcuuauuuuaagcaua

SEQ ID NO: 5530 - RNA, 19 nt, Artificial Sequence
  source: /note="Description of Artificial Sequence: Synthetic oligonucleotide"
auagauccaccugcuuauu

SEQ ID NO: 5531 - RNA, 19 nt, Artificial Sequence
  source: /note="Description of Artificial Sequence: Synthetic oligonucleotide"
ggugaccacauuuauauca

SEQ ID NO: 5532 - RNA, 19 nt, Artificial Sequence
  source: /note="Description of Artificial Sequence: Synthetic oligonucleotide"
ucuuacugauuuacccuac

SEQ ID NO: 5533 - RNA, 19 nt, Artificial Sequence
  source: /note="Description of Artificial Sequence: Synthetic oligonucleotide"
gcaaggcuaggguuugaua

SEQ ID NO: 5534 - RNA, 19 nt, Artificial Sequence
  source: /note="Description of Artificial Sequence: Synthetic oligonucleotide"
acaacuuugggauaaaagg

SEQ ID NO: 5535 - RNA, 19 nt, Artificial Sequence
  source: /note="Description of Artificial Sequence: Synthetic oligonucleotide"
cuuacugauuuacccuacc

SEQ ID NO: 5536 - RNA, 19 nt, Artificial Sequence
  source: /note="Description of Artificial Sequence: Synthetic oligonucleotide"
gauuuacaggucaguauca

SEQ ID NO: 5537 - RNA, 19 nt, Artificial Sequence
  source: /note="Description of Artificial Sequence: Synthetic oligonucleotide"
caucugugaugguucagcc

SEQ ID NO: 5538 - RNA, 19 nt, Artificial Sequence
  source: /note="Description of Artificial Sequence: Synthetic oligonucleotide"
aucauccuggcgauaucca

SEQ ID NO: 5539 - RNA, 19 nt, Artificial Sequence
  source: /note="Description of Artificial Sequence: Synthetic oligonucleotide"
gcuggucagaugacgaaga

SEQ ID NO: 5540 - RNA, 19 nt, Artificial Sequence
  source: /note="Description of Artificial Sequence: Synthetic oligonucleotide"
cagaggaccccugcagcua

SEQ ID NO: 5541 - RNA, 19 nt, Artificial Sequence
  source: /note="Description of Artificial Sequence: Synthetic oligonucleotide"
aucacagcagguuacaaca

SEQ ID NO: 5542 - RNA, 19 nt, Artificial Sequence
  source: /note="Description of Artificial Sequence: Synthetic oligonucleotide"
auaacaccucuuacugauu

SEQ ID NO: 5543 - RNA, 19 nt, Artificial Sequence
  source: /note="Description of Artificial Sequence: Synthetic oligonucleotide"
aucugugaugguucagcca

SEQ ID NO: 5544 - RNA, 19 nt, Artificial Sequence
  source: /note="Description of Artificial Sequence: Synthetic oligonucleotide"
ugaauuaaaaguuuaauuc

SEQ ID NO: 5545 - RNA, 19 nt, Artificial Sequence
  source: /note="Description of Artificial Sequence: Synthetic oligonucleotide"
aaguuuaauucugaaccau

SEQ ID NO: 5546 - RNA, 19 nt, Artificial Sequence
  source: /note="Description of Artificial Sequence: Synthetic oligonucleotide"
gaauuaguguucuacacca

SEQ ID NO: 5547 - RNA, 19 nt, Artificial Sequence
  source: /note="Description of Artificial Sequence: Synthetic oligonucleotide"
aauuaguguucuacaccau

SEQ ID NO: 5548 - RNA, 19 nt, Artificial Sequence
  source: /note="Description of Artificial Sequence: Synthetic oligonucleotide"
gggaucugcaugcccucau

SEQ ID NO: 5549 - RNA, 19 nt, Artificial Sequence
  source: /note="Description of Artificial Sequence: Synthetic oligonucleotide"
uaucacagcagguuacaac

SEQ ID NO: 5550 - RNA, 19 nt, Artificial Sequence
  source: /note="Description of Artificial Sequence: Synthetic oligonucleotide"
caucaacuggauagucagc

SEQ ID NO: 5551 - RNA, 19 nt, Artificial Sequence
  source: /note="Description of Artificial Sequence: Synthetic oligonucleotide"
aaauagauccaccugcuua

SEQ ID NO: 5552 - RNA, 19 nt, Artificial Sequence
  source: /note="Description of Artificial Sequence: Synthetic oligonucleotide"
gauccaccugcuuauuuua

SEQ ID NO: 5553 - RNA, 19 nt, Artificial Sequence
  source: /note="Description of Artificial Sequence: Synthetic oligonucleotide"
aggugaccacauuuauauc

SEQ ID NO: 5554 - RNA, 19 nt, Artificial Sequence
  source: /note="Description of Artificial Sequence: Synthetic oligonucleotide"
caccuucagcacucugcuu

SEQ ID NO: 5555 - RNA, 19 nt, Artificial Sequence
  source: /note="Description of Artificial Sequence: Synthetic oligonucleotide"
uguccugagcaaguucaca

SEQ ID NO: 5556 - RNA, 19 nt, Artificial Sequence
  source: /note="Description of Artificial Sequence: Synthetic oligonucleotide"
gcuggacauuagugggaug

SEQ ID NO: 5557 - RNA, 19 nt, Artificial Sequence
  source: /note="Description of Artificial Sequence: Synthetic oligonucleotide"
gcagguuacaacaacuuug

SEQ ID NO: 5558 - RNA, 19 nt, Artificial Sequence
  source: /note="Description of Artificial Sequence: Synthetic oligonucleotide"
aacaccucuuacugauuua

SEQ ID NO: 5559 - RNA, 19 nt, Artificial Sequence
  source: /note="Description of Artificial Sequence: Synthetic oligonucleotide"
agucucauuccaagccauu

SEQ ID NO: 5560 - RNA, 19 nt, Artificial Sequence
  source: /note="Description of Artificial Sequence: Synthetic oligonucleotide"
gcaaguucacagaggaccc

SEQ ID NO: 5561 - RNA, 19 nt, Artificial Sequence
  source: /note="Description of Artificial Sequence: Synthetic oligonucleotide"
uccauuuguauuguuacuc

SEQ ID NO: 5562 - RNA, 19 nt, Artificial Sequence
  source: /note="Description of Artificial Sequence: Synthetic oligonucleotide"
uuaguguucuacaccauua

SEQ ID NO: 5563 - RNA, 19 nt, Artificial Sequence
  source: /note="Description of Artificial Sequence: Synthetic oligonucleotide"
uugaguagccauuguccac

SEQ ID NO: 5564 - RNA, 19 nt, Artificial Sequence
  source: /note="Description of Artificial Sequence: Synthetic oligonucleotide"
ugagaguccaaagacaguu

SEQ ID NO: 5565 - RNA, 19 nt, Artificial Sequence
  source: /note="Description of Artificial Sequence: Synthetic oligonucleotide"
uggauagucagcaccaggg

SEQ ID NO: 5566 - RNA, 19 nt, Artificial Sequence
  source: /note="Description of Artificial Sequence: Synthetic oligonucleotide"
caugaaauagauccaccug

SEQ ID NO: 5567 - RNA, 19 nt, Artificial Sequence
  source: /note="Description of Artificial Sequence: Synthetic oligonucleotide"
ucaguaucaaaccaggcca

SEQ ID NO: 5568 - RNA, 19 nt, Artificial Sequence
  source: /note="Description of Artificial Sequence: Synthetic oligonucleotide"
guaucaaaccaggccagcu

SEQ ID NO: 5569 - RNA, 19 nt, Artificial Sequence
  source: /note="Description of Artificial Sequence: Synthetic oligonucleotide"
gacgaagagcacagauggc

SEQ ID NO: 5570 - RNA, 19 nt, Artificial Sequence
  source: /note="Description of Artificial Sequence: Synthetic oligonucleotide"
cacaaacaauggaauggua

SEQ ID NO: 5571 - RNA, 19 nt, Artificial Sequence
  source: /note="Description of Artificial Sequence: Synthetic oligonucleotide"
uccuggcgauauccaaggg

SEQ ID NO: 5572 - RNA, 19 nt, Artificial Sequence
  source: /note="Description of Artificial Sequence: Synthetic oligonucleotide"
gcucagugaugucuucccu

SEQ ID NO: 5573 - RNA, 19 nt, Artificial Sequence
  source: /note="Description of Artificial Sequence: Synthetic oligonucleotide"
uugcacguguggcaaguuc

SEQ ID NO: 5574 - RNA, 19 nt, Artificial Sequence
  source: /note="Description of Artificial Sequence: Synthetic oligonucleotide"
uuuacaggucaguaucaaa

SEQ ID NO: 5575 - RNA, 19 nt, Artificial Sequence
  source: /note="Description of Artificial Sequence: Synthetic oligonucleotide"
gguuacaacaacuuuggga

SEQ ID NO: 5576 - RNA, 19 nt, Artificial Sequence
  source: /note="Description of Artificial Sequence: Synthetic oligonucleotide"
cuacaucauuuguauucug

SEQ ID NO: 5577 - RNA, 19 nt, Artificial Sequence
  source: /note="Description of Artificial Sequence: Synthetic oligonucleotide"
acaugaaauagauccaccu

SEQ ID NO: 5578 - RNA, 19 nt, Artificial Sequence
  source: /note="Description of Artificial Sequence: Synthetic oligonucleotide"
ggacauuagugggaugagc

SEQ ID NO: 5579 - RNA, 19 nt, Artificial Sequence
  source: /note="Description of Artificial Sequence: Synthetic oligonucleotide"
cuggauagucagcaccagg

SEQ ID NO: 5580 - RNA, 19 nt, Artificial Sequence
  source: /note="Description of Artificial Sequence: Synthetic oligonucleotide"
ggcaccagaauggauucca

SEQ ID NO: 5581 - RNA, 19 nt, Artificial Sequence
  source: /note="Description of Artificial Sequence: Synthetic oligonucleotide"
cccauccaugagguccugg

SEQ ID NO: 5582 - RNA, 19 nt, Artificial Sequence
  source: /note="Description of Artificial Sequence: Synthetic oligonucleotide"
aauuauugcaagugagguu

SEQ ID NO: 5583 - RNA, 19 nt, Artificial Sequence
  source: /note="Description of Artificial Sequence: Synthetic oligonucleotide"
uugggauaaaaggcaacug

SEQ ID NO: 5584 - RNA, 19 nt, Artificial Sequence
  source: /note="Description of Artificial Sequence: Synthetic oligonucleotide"
uuaugaauuaguguucuac

SEQ ID NO: 5585 - RNA, 19 nt, Artificial Sequence
  source: /note="Description of Artificial Sequence: Synthetic oligonucleotide"
cagcccaucaacuggauag

SEQ ID NO: 5586 - RNA, 19 nt, Artificial Sequence
  source: /note="Description of Artificial Sequence: Synthetic oligonucleotide"
ccuuuaucagaggccagug

SEQ ID NO: 5587 - RNA, 19 nt, Artificial Sequence
  source: /note="Description of Artificial Sequence: Synthetic oligonucleotide"
cugagaguccaaagacagu

SEQ ID NO: 5588 - RNA, 19 nt, Artificial Sequence
  source: /note="Description of Artificial Sequence: Synthetic oligonucleotide"
ucucauuccaagccauugg

SEQ ID NO: 5589 - RNA, 19 nt, Artificial Sequence
  source: /note="Description of Artificial Sequence: Synthetic oligonucleotide"
ccaccugcuuauuuuaagc

SEQ ID NO: 5590 - RNA, 19 nt, Artificial Sequence
  source: /note="Description of Artificial Sequence: Synthetic oligonucleotide"
gaugacgaagagcacagau

SEQ ID NO: 5591 - RNA, 19 nt, Artificial Sequence
  source: /note="Description of Artificial Sequence: Synthetic oligonucleotide"
agguuacaacaacuuuggg

SEQ ID NO: 5592 - RNA, 19 nt, Artificial Sequence
  source: /note="Description of Artificial Sequence: Synthetic oligonucleotide"
ggacguacggcgcugggua

SEQ ID NO: 5593 - RNA, 19 nt, Artificial Sequence
  source: /note="Description of Artificial Sequence: Synthetic oligonucleotide"
ggagaacgcaugauagcgu

SEQ ID NO: 5594 - RNA, 19 nt, Artificial Sequence
  source: /note="Description of Artificial Sequence: Synthetic oligonucleotide"
gcucacgcaaaggugcaug

SEQ ID NO: 5595 - RNA, 19 nt, Artificial Sequence
  source: /note="Description of Artificial Sequence: Synthetic oligonucleotide"
gugaaggcgaacugcauuc

SEQ ID NO: 5596 - RNA, 19 nt, Artificial Sequence
  source: /note="Description of Artificial Sequence: Synthetic oligonucleotide"
cuagucguggaauggcacc

SEQ ID NO: 5597 - RNA, 19 nt, Artificial Sequence
  source: /note="Description of Artificial Sequence: Synthetic oligonucleotide"
cagugacuaacagccgcuu

SEQ ID NO: 5598 - RNA, 19 nt, Artificial Sequence
  source: /note="Description of Artificial Sequence: Synthetic oligonucleotide"
ucguacccucugagcucga

SEQ ID NO: 5599 - RNA, 19 nt, Artificial Sequence
  source: /note="Description of Artificial Sequence: Synthetic oligonucleotide"
gaacgcaugauagcguguc

SEQ ID NO: 5600 - RNA, 19 nt, Artificial Sequence
  source: /note="Description of Artificial Sequence: Synthetic oligonucleotide"
aggagaacgcaugauagcg

SEQ ID NO: 5601 - RNA, 19 nt, Artificial Sequence
  source: /note="Description of Artificial Sequence: Synthetic oligonucleotide"
uacguacaauagcagacac

SEQ ID NO: 5602 - RNA, 19 nt, Artificial Sequence
  source: /note="Description of Artificial Sequence: Synthetic oligonucleotide"
gcuuauuacuagagcagac

SEQ ID NO: 5603 - RNA, 19 nt, Artificial Sequence
  source: /note="Description of Artificial Sequence: Synthetic oligonucleotide"
acuagucguggaauggcac

SEQ ID NO: 5604 - RNA, 19 nt, Artificial Sequence
  source: /note="Description of Artificial Sequence: Synthetic oligonucleotide"
acaauucgguugugaacau

SEQ ID NO: 5605 - RNA, 19 nt, Artificial Sequence
  source: /note="Description of Artificial Sequence: Synthetic oligonucleotide"
gcaacugaacuagucgugg

SEQ ID NO: 5606 - RNA, 19 nt, Artificial Sequence
  source: /note="Description of Artificial Sequence: Synthetic oligonucleotide"
agcaacugaacuagucgug

SEQ ID NO: 5607 - RNA, 19 nt, Artificial Sequence
  source: /note="Description of Artificial Sequence: Synthetic oligonucleotide"
acgaacaagcaacugaacu

SEQ ID NO: 5608 - RNA, 19 nt, Artificial Sequence
  source: /note="Description of Artificial Sequence: Synthetic oligonucleotide"
auggacguacggcgcuggg

SEQ ID NO: 5609 - RNA, 19 nt, Artificial Sequence
  source: /note="Description of Artificial Sequence: Synthetic oligonucleotide"
uccuagagugaaguaacuc

SEQ ID NO: 5610 - RNA, 19 nt, Artificial Sequence
  source: /note="Description of Artificial Sequence: Synthetic oligonucleotide"
ucgagucauugcauacugu

SEQ ID NO: 5611 - RNA, 19 nt, Artificial Sequence
  source: /note="Description of Artificial Sequence: Synthetic oligonucleotide"
gagcucgagucauugcaua

SEQ ID NO: 5612 - RNA, 19 nt, Artificial Sequence
  source: /note="Description of Artificial Sequence: Synthetic oligonucleotide"
aacgcuggacauuaguggg

SEQ ID NO: 5613 - RNA, 19 nt, Artificial Sequence
  source: /note="Description of Artificial Sequence: Synthetic oligonucleotide"
ggaaagguuaugcaagguc

SEQ ID NO: 5614 - RNA, 19 nt, Artificial Sequence
  source: /note="Description of Artificial Sequence: Synthetic oligonucleotide"
aaggcagucugucguaaua

SEQ ID NO: 5615 - RNA, 19 nt, Artificial Sequence
  source: /note="Description of Artificial Sequence: Synthetic oligonucleotide"
uggugucggcuggucagau

SEQ ID NO: 5616 - RNA, 19 nt, Artificial Sequence
  source: /note="Description of Artificial Sequence: Synthetic oligonucleotide"
cugaacuagucguggaaug

SEQ ID NO: 5617 - RNA, 19 nt, Artificial Sequence
  source: /note="Description of Artificial Sequence: Synthetic oligonucleotide"
cacgcuggauuuucaaaac

SEQ ID NO: 5618 - RNA, 19 nt, Artificial Sequence
  source: /note="Description of Artificial Sequence: Synthetic oligonucleotide"
ugaugguucagccaaacgc

SEQ ID NO: 5619 - RNA, 19 nt, Artificial Sequence
  source: /note="Description of Artificial Sequence: Synthetic oligonucleotide"
agaacgcaugauagcgugu

SEQ ID NO: 5620 - RNA, 19 nt, Artificial Sequence
  source: /note="Description of Artificial Sequence: Synthetic oligonucleotide"
ggagaguuguaauggcaua

SEQ ID NO: 5621 - RNA, 19 nt, Artificial Sequence
  source: /note="Description of Artificial Sequence: Synthetic oligonucleotide"
ggcuuauuacuagagcaga

SEQ ID NO: 5622 - RNA, 19 nt, Artificial Sequence
  source: /note="Description of Artificial Sequence: Synthetic oligonucleotide"
uucgguugugaacaucccg

SEQ ID NO: 5623 - RNA, 19 nt, Artificial Sequence
  source: /note="Description of Artificial Sequence: Synthetic oligonucleotide"
caaaauccauuuguauugu

SEQ ID NO: 5624 - RNA, 19 nt, Artificial Sequence
  source: /note="Description of Artificial Sequence: Synthetic oligonucleotide"
acucccaaaauccauuugu

SEQ ID NO: 5625 - RNA, 19 nt, Artificial Sequence
  source: /note="Description of Artificial Sequence: Synthetic oligonucleotide"
cuucuugagucacucccaa

SEQ ID NO: 5626 - RNA, 19 nt, Artificial Sequence
  source: /note="Description of Artificial Sequence: Synthetic oligonucleotide"
acuucuugagucacuccca

SEQ ID NO: 5627 - RNA, 19 nt, Artificial Sequence
  source: /note="Description of Artificial Sequence: Synthetic oligonucleotide"
cuugugcauucuucacuuc

SEQ ID NO: 5628 - RNA, 19 nt, Artificial Sequence
  source: /note="Description of Artificial Sequence: Synthetic oligonucleotide"
ucuugugcauucuucacuu

SEQ ID NO: 5629 - RNA, 19 nt, Artificial Sequence
  source: /note="Description of Artificial Sequence: Synthetic oligonucleotide"
ggguuugauaaauuccauc

SEQ ID NO: 5630 - RNA, 19 nt, Artificial Sequence
  source: /note="Description of Artificial Sequence: Synthetic oligonucleotide"
aggguuugauaaauuccau

SEQ ID NO: 5631 - RNA, 19 nt, Artificial Sequence
  source: /note="Description of Artificial Sequence: Synthetic oligonucleotide"
cuaggguuugauaaauucc

SEQ ID NO: 5632 - RNA, 19 nt, Artificial Sequence
  source: /note="Description of Artificial Sequence: Synthetic oligonucleotide"
gcuaggguuugauaaauuc

SEQ ID NO: 5633 - RNA, 19 nt, Artificial Sequence
  source: /note="Description of Artificial Sequence: Synthetic oligonucleotide"
ggcuaggguuugauaaauu

SEQ ID NO: 5634 - RNA, 19 nt, Artificial Sequence
  source: /note="Description of Artificial Sequence: Synthetic oligonucleotide"
aguaccauuacagauauuc

SEQ ID NO: 5635 - RNA, 19 nt, Artificial Sequence
  source: /note="Description of Artificial Sequence: Synthetic oligonucleotide"
caguaccauuacagauauu

SEQ ID NO: 5636 - RNA, 19 nt, Artificial Sequence
  source: /note="Description of Artificial Sequence: Synthetic oligonucleotide"
ucaguaccauuacagauau

SEQ ID NO: 5637 - RNA, 19 nt, Artificial Sequence
  source: /note="Description of Artificial Sequence: Synthetic oligonucleotide"
cacuacgagagacuuaaaa

SEQ ID NO: 5638 - RNA, 19 nt, Artificial Sequence
  source: /note="Description of Artificial Sequence: Synthetic oligonucleotide"
acacuacgagagacuuaaa

SEQ ID NO: 5639 - RNA, 19 nt, Artificial Sequence
  source: /note="Description of Artificial Sequence: Synthetic oligonucleotide"
cuuaacacuacgagagacu

SEQ ID NO: 5640 - RNA, 19 nt, Artificial Sequence
  source: /note="Description of Artificial Sequence: Synthetic oligonucleotide"
cuauaacuuaacacuacga

SEQ ID NO: 5641 - RNA, 19 nt, Artificial Sequence
  source: /note="Description of Artificial Sequence: Synthetic oligonucleotide"
acuauaacuuaacacuacg

SEQ ID NO: 5642 - RNA, 19 nt, Artificial Sequence
  source: /note="Description of Artificial Sequence: Synthetic oligonucleotide"
cacuauaacuuaacacuac

SEQ ID NO: 5643 - RNA, 19 nt, Artificial Sequence
  source: /note="Description of Artificial Sequence: Synthetic oligonucleotide"
ucacuauaacuuaacacua

SEQ ID NO: 5644 - RNA, 19 nt, Artificial Sequence
  source: /note="Description of Artificial Sequence: Synthetic oligonucleotide"
gcuguagcaguauucacua

SEQ ID NO: 5645 - RNA, 19 nt, Artificial Sequence
  source: /note="Description of Artificial Sequence: Synthetic oligonucleotide"
gugauuaugaauuaguguu

SEQ ID NO: 5646 - RNA, 19 nt, Artificial Sequence
  source: /note="Description of Artificial Sequence: Synthetic oligonucleotide"
agugauuaugaauuagugu

SEQ ID NO: 5647 - RNA, 19 nt, Artificial Sequence
  source: /note="Description of Artificial Sequence: Synthetic oligonucleotide"
uuuauucagauuacaauua

SEQ ID NO: 5648 - RNA, 19 nt, Artificial Sequence
  source: /note="Description of Artificial Sequence: Synthetic oligonucleotide"
acuuuauucagauuacaau

SEQ ID NO: 5649 - RNA, 19 nt, Artificial Sequence
  source: /note="Description of Artificial Sequence: Synthetic oligonucleotide"
cacuuuauucagauuacaa

SEQ ID NO: 5650 - RNA, 19 nt, Artificial Sequence
  source: /note="Description of Artificial Sequence: Synthetic oligonucleotide"
acacuuuauucagauuaca

SEQ ID NO: 5651 - RNA, 19 nt, Artificial Sequence
  source: /note="Description of Artificial Sequence: Synthetic oligonucleotide"
ggaccauuuucuauuuguc

SEQ ID NO: 5652 - RNA, 19 nt, Artificial Sequence
  source: /note="Description of Artificial Sequence: Synthetic oligonucleotide"
uggaccauuuucuauuugu

SEQ ID NO: 5653 - RNA, 19 nt, Artificial Sequence
  source: /note="Description of Artificial Sequence: Synthetic oligonucleotide"
cuaauuggaccauuuucua

SEQ ID NO: 5654 - RNA, 19 nt, Artificial Sequence
  source: /note="Description of Artificial Sequence: Synthetic oligonucleotide"
acuaauuggaccauuuucu

SEQ ID NO: 5655 - RNA, 19 nt, Artificial Sequence
  source: /note="Description of Artificial Sequence: Synthetic oligonucleotide"
cccauacauaucccaaaua

SEQ ID NO: 5656 - RNA, 19 nt, Artificial Sequence
  source: /note="Description of Artificial Sequence: Synthetic oligonucleotide"
acccauacauaucccaaau

SEQ ID NO: 5657 - RNA, 19 nt, Artificial Sequence
  source: /note="Description of Artificial Sequence: Synthetic oligonucleotide"
cuacccauacauaucccaa

SEQ ID NO: 5658 - RNA, 19 nt, Artificial Sequence
  source: /note="Description of Artificial Sequence: Synthetic oligonucleotide"
acccuacccauacauaucc

SEQ ID NO: 5659 - RNA, 19 nt, Artificial Sequence
  source: /note="Description of Artificial Sequence: Synthetic oligonucleotide"
guuccaaauaacaccucuu

SEQ ID NO: 5660 - RNA, 19 nt, Artificial Sequence
  source: /note="Description of Artificial Sequence: Synthetic oligonucleotide"
gguuccaaauaacaccucu

SEQ ID NO: 5661 - RNA, 19 nt, Artificial Sequence
  source: /note="Description of Artificial Sequence: Synthetic oligonucleotide"
agguuccaaauaacaccuc

SEQ ID NO: 5662 - RNA, 19 nt, Artificial Sequence
  source: /note="Description of Artificial Sequence: Synthetic oligonucleotide"
uguccaaaacaagguucca

SEQ ID NO: 5663 - RNA, 19 nt, Artificial Sequence
  source: /note="Description of Artificial Sequence: Synthetic oligonucleotide"
cuguccaaaacaagguucc

SEQ ID NO: 5664 - RNA, 19 nt, Artificial Sequence
  source: /note="Description of Artificial Sequence: Synthetic oligonucleotide"
acuguccaaaacaagguuc

SEQ ID NO: 5665 - RNA, 19 nt, Artificial Sequence
  source: /note="Description of Artificial Sequence: Synthetic oligonucleotide"
cugguaaacuguccaaaac

SEQ ID NO: 5666 - RNA, 19 nt, Artificial Sequence
  source: /note="Description of Artificial Sequence: Synthetic oligonucleotide"
acugguaaacuguccaaaa

SEQ ID NO: 5667 - RNA, 19 nt, Artificial Sequence
  source: /note="Description of Artificial Sequence: Synthetic oligonucleotide"
caacugguaaacuguccaa

SEQ ID NO: 5668 - RNA, 19 nt, Artificial Sequence
  source: /note="Description of Artificial Sequence: Synthetic oligonucleotide"
cacagcagguuacaacaac

SEQ ID NO: 5669 - RNA, 19 nt, Artificial Sequence
  source: /note="Description of Artificial Sequence: Synthetic oligonucleotide"
ucacagcagguuacaacaa

SEQ ID NO: 5670 - RNA, 19 nt, Artificial Sequence
  source: /note="Description of Artificial Sequence: Synthetic oligonucleotide"
guaucacagcagguuacaa

SEQ ID NO: 5671 - RNA, 19 nt, Artificial Sequence
  source: /note="Description of Artificial Sequence: Synthetic oligonucleotide"
gcauuuucucuugaagcau

SEQ ID NO: 5672 - RNA, 19 nt, Artificial Sequence
  source: /note="Description of Artificial Sequence: Synthetic oligonucleotide"
uucuugugcauucuucacu

SEQ ID NO: 5673 - RNA, 19 nt, Artificial Sequence
  source: /note="Description of Artificial Sequence: Synthetic oligonucleotide"
uuccaucuugugauccauu

SEQ ID NO: 5674 - RNA, 19 nt, Artificial Sequence
  source: /note="Description of Artificial Sequence: Synthetic oligonucleotide"
auuccaucuugugauccau

SEQ ID NO: 5675 - RNA, 19 nt, Artificial Sequence
  source: /note="Description of Artificial Sequence: Synthetic oligonucleotide"
aauuccaucuugugaucca

SEQ ID NO: 5676 - RNA, 19 nt, Artificial Sequence
  source: /note="Description of Artificial Sequence: Synthetic oligonucleotide"
aaauuccaucuugugaucc

SEQ ID NO: 5677 - RNA, 19 nt, Artificial Sequence
  source: /note="Description of Artificial Sequence: Synthetic oligonucleotide"
uaaauuccaucuugugauc

SEQ ID NO: 5678 - RNA, 19 nt, Artificial Sequence
  source: /note="Description of Artificial Sequence: Synthetic oligonucleotide"
auaaauuccaucuugugau

SEQ ID NO: 5679 - RNA, 19 nt, Artificial Sequence
  source: /note="Description of Artificial Sequence: Synthetic oligonucleotide"
uaggguuugauaaauucca

SEQ ID NO: 5680 - RNA, 19 nt, Artificial Sequence
  source: /note="Description of Artificial Sequence: Synthetic oligonucleotide"
uaacaagcaaggcuagggu

SEQ ID NO: 5681 - RNA, 19 nt, Artificial Sequence
  source: /note="Description of Artificial Sequence: Synthetic oligonucleotide"
uuaacaagcaaggcuaggg

SEQ ID NO: 5682 - RNA, 19 nt, Artificial Sequence
  source: /note="Description of Artificial Sequence: Synthetic oligonucleotide"
uuuaacaagcaaggcuagg

SEQ ID NO: 5683 - RNA, 19 nt, Artificial Sequence
  source: /note="Description of Artificial Sequence: Synthetic oligonucleotide"
auuuaacaagcaaggcuag

SEQ ID NO: 5684 - RNA, 19 nt, Artificial Sequence
  source: /note="Description of Artificial Sequence: Synthetic oligonucleotide"
aauuuaacaagcaaggcua

SEQ ID NO: 5685 - RNA, 19 nt, Artificial Sequence
  source: /note="Description of Artificial Sequence: Synthetic oligonucleotide"
aaauuuaacaagcaaggcu

SEQ ID NO: 5686 - RNA, 19 nt, Artificial Sequence
  source: /note="Description of Artificial Sequence: Synthetic oligonucleotide"
aacacuacgagagacuuaa

SEQ ID NO: 5687 - RNA, 19 nt, Artificial Sequence
  source: /note="Description of Artificial Sequence: Synthetic oligonucleotide"
uaacacuacgagagacuua

SEQ ID NO: 5688 - RNA, 19 nt, Artificial Sequence
  source: /note="Description of Artificial Sequence: Synthetic oligonucleotide"
uuaacacuacgagagacuu

SEQ ID NO: 5689 - RNA, 19 nt, Artificial Sequence
  source: /note="Description of Artificial Sequence: Synthetic oligonucleotide"
uauaacuuaacacuacgag

SEQ ID NO: 5690 - RNA, 19 nt, Artificial Sequence
  source: /note="Description of Artificial Sequence: Synthetic oligonucleotide"
uucacuauaacuuaacacu

SEQ ID NO: 5691 - RNA, 19 nt, Artificial Sequence
  source: /note="Description of Artificial Sequence: Synthetic oligonucleotide"
auucacuauaacuuaacac

SEQ ID NO: 5692 - RNA, 19 nt, Artificial Sequence
  source: /note="Description of Artificial Sequence: Synthetic oligonucleotide"
aaauuagaaauugcuguag

SEQ ID NO: 5693 - RNA, 19 nt, Artificial Sequence
  source: /note="Description of Artificial Sequence: Synthetic oligonucleotide"
uuggaccauuuucuauuug

SEQ ID NO: 5694 - RNA, 19 nt, Artificial Sequence
  source: /note="Description of Artificial Sequence: Synthetic oligonucleotide"
uaauuggaccauuuucuau

SEQ ID NO: 5695 - RNA, 19 nt, Artificial Sequence
  source: /note="Description of Artificial Sequence: Synthetic oligonucleotide"
uacccauacauaucccaaa

SEQ ID NO: 5696 - RNA, 19 nt, Artificial Sequence
  source: /note="Description of Artificial Sequence: Synthetic oligonucleotide"
uacccuacccauacauauc

SEQ ID NO: 5697 - RNA, 19 nt, Artificial Sequence
  source: /note="Description of Artificial Sequence: Synthetic oligonucleotide"
uacugauuuacccuaccca

SEQ ID NO: 5698 - RNA, 19 nt, Artificial Sequence
  source: /note="Description of Artificial Sequence: Synthetic oligonucleotide"
uuccaaauaacaccucuua

SEQ ID NO: 5699 - RNA, 19 nt, Artificial Sequence
  source: /note="Description of Artificial Sequence: Synthetic oligonucleotide"
aacuuugggauaaaaggca

SEQ ID NO: 5700 - RNA, 19 nt, Artificial Sequence
  source: /note="Description of Artificial Sequence: Synthetic oligonucleotide"
aucacagcagguuacaaca

SEQ ID NO: 5701 - RNA, 19 nt, Artificial Sequence
  source: /note="Description of Artificial Sequence: Synthetic oligonucleotide"
uaucacagcagguuacaac

SEQ ID NO: 5702 - RNA, 19 nt, Artificial Sequence
  source: /note="Description of Artificial Sequence: Synthetic oligonucleotide"
auaaccgcauuuucucuug

SEQ ID NO: 5703 - RNA, 19 nt, Artificial Sequence
  source: /note="Description of Artificial Sequence: Synthetic oligonucleotide"
uauaaccgcauuuucucuu

SEQ ID NO: 5704 - RNA, 19 nt, Artificial Sequence
  source: /note="Description of Artificial Sequence: Synthetic oligonucleotide"
auacccucaggggaacagg

SEQ ID NO: 5705 - RNA, 19 nt, Artificial Sequence
  source: /note="Description of Artificial Sequence: Synthetic oligonucleotide"
aauacccucaggggaacag

SEQ ID NO: 5706 - RNA, 19 nt, Artificial Sequence
  source: /note="Description of Artificial Sequence: Synthetic oligonucleotide"
uacuucaaauacccucagg

SEQ ID NO: 5707 - RNA, 19 nt, Artificial Sequence
  source: /note="Description of Artificial Sequence: Synthetic oligonucleotide"
auacuucaaauacccucag

SEQ ID NO: 5708 - RNA, 19 nt, Artificial Sequence
  source: /note="Description of Artificial Sequence: Synthetic oligonucleotide"
uauacuucaaauacccuca

SEQ ID NO: 5709 - RNA, 19 nt, Artificial Sequence
  source: /note="Description of Artificial Sequence: Synthetic oligonucleotide"
augguauacuucaaauacc

SEQ ID NO: 5710 - RNA, 19 nt, Artificial Sequence
  source: /note="Description of Artificial Sequence: Synthetic oligonucleotide"
uaugguauacuucaaauac

SEQ ID NO: 5711 - RNA, 19 nt, Artificial Sequence
  source: /note="Description of Artificial Sequence: Synthetic oligonucleotide"
uuguaugguauacuucaaa

SEQ ID NO: 5712 - RNA, 19 nt, Artificial Sequence
  source: /note="Description of Artificial Sequence: Synthetic oligonucleotide"
aacaguuguaugguauacu

SEQ ID NO: 5713 - RNA, 19 nt, Artificial Sequence
  source: /note="Description of Artificial Sequence: Synthetic oligonucleotide"
aaacaguuguaugguauac

SEQ ID NO: 5714 - RNA, 19 nt, Artificial Sequence
  source: /note="Description of Artificial Sequence: Synthetic oligonucleotide"
aaaacaguuguaugguaua

SEQ ID NO: 5715 - RNA, 19 nt, Artificial Sequence
  source: /note="Description of Artificial Sequence: Synthetic oligonucleotide"
uucaaaacaguuguauggu

SEQ ID NO: 5716 - RNA, 19 nt, Artificial Sequence
  source: /note="Description of Artificial Sequence: Synthetic oligonucleotide"
uuucaaaacaguuguaugg

SEQ ID NO: 5717 - RNA, 19 nt, Artificial Sequence
  source: /note="Description of Artificial Sequence: Synthetic oligonucleotide"
uuguccacgcuggauuuuc

SEQ ID NO: 5718 - RNA, 19 nt, Artificial Sequence
  source: /note="Description of Artificial Sequence: Synthetic oligonucleotide"
auuguccacgcuggauuuu

SEQ ID NO: 5719 - RNA, 19 nt, Artificial Sequence
  source: /note="Description of Artificial Sequence: Synthetic oligonucleotide"
uagccauuguccacgcugg

SEQ ID NO: 5720 - RNA, 19 nt, Artificial Sequence
  source: /note="Description of Artificial Sequence: Synthetic oligonucleotide"
uugaguagccauuguccac

SEQ ID NO: 5721 - RNA, 19 nt, Artificial Sequence
  source: /note="Description of Artificial Sequence: Synthetic oligonucleotide"
aucagcuugaguagccauu

SEQ ID NO: 5722 - RNA, 19 nt, Artificial Sequence
  source: /note="Description of Artificial Sequence: Synthetic oligonucleotide"
aaucagcuugaguagccau

SEQ ID NO: 5723 - RNA, 19 nt, Artificial Sequence
  source: /note="Description of Artificial Sequence: Synthetic oligonucleotide"
aaaucagcuugaguagcca

SEQ ID NO: 5724 - RNA, 19 nt, Artificial Sequence
  source: /note="Description of Artificial Sequence: Synthetic oligonucleotide"
aucaaaucagcuugaguag

SEQ ID NO: 5725 - RNA, 19 nt, Artificial Sequence
  source: /note="Description of Artificial Sequence: Synthetic oligonucleotide"
auguccaacuccaucaaau

SEQ ID NO: 5726 - RNA, 19 nt, Artificial Sequence
  source: /note="Description of Artificial Sequence: Synthetic oligonucleotide"
auggccauguccaacucca

SEQ ID NO: 5727 - RNA, 19 nt, Artificial Sequence
  source: /note="Description of Artificial Sequence: Synthetic oligonucleotide"
uuccauggccauguccaac

SEQ ID NO: 5728 - RNA, 19 nt, Artificial Sequence
  source: /note="Description of Artificial Sequence: Synthetic oligonucleotide"
uucugucugguuccauggc

SEQ ID NO: 5729 - RNA, 19 nt, Artificial Sequence
  source: /note="Description of Artificial Sequence: Synthetic oligonucleotide"
uuuucugucugguuccaug

SEQ ID NO: 5730 - RNA, 19 nt, Artificial Sequence
  source: /note="Description of Artificial Sequence: Synthetic oligonucleotide"
uuccuccgucuccgccucc

SEQ ID NO: 5731 - RNA, 19 nt, Artificial Sequence
  source: /note="Description of Artificial Sequence: Synthetic oligonucleotide"
aacagccgcuuuucugucu

SEQ ID NO: 5732 - RNA, 19 nt, Artificial Sequence
  source: /note="Description of Artificial Sequence: Synthetic oligonucleotide"
uaacagccgcuuuucuguc

SEQ ID NO: 5733 - RNA, 19 nt, Artificial Sequence
  source: /note="Description of Artificial Sequence: Synthetic oligonucleotide"
uugcugccagugacuaaca

SEQ ID NO: 5734 - RNA, 19 nt, Artificial Sequence
  source: /note="Description of Artificial Sequence: Synthetic oligonucleotide"
aagacuguugcugccagug

SEQ ID NO: 5735 - RNA, 19 nt, Artificial Sequence
  source: /note="Description of Artificial Sequence: Synthetic oligonucleotide"
uaagacuguugcugccagu

SEQ ID NO: 5736 - RNA, 19 nt, Artificial Sequence
  source: /note="Description of Artificial Sequence: Synthetic oligonucleotide"
uuccagaguccagguaaga

SEQ ID NO: 5737 - RNA, 19 nt, Artificial Sequence
  source: /note="Description of Artificial Sequence: Synthetic oligonucleotide"
auuccagaguccagguaag

SEQ ID NO: 5738 - RNA, 19 nt, Artificial Sequence
  source: /note="Description of Artificial Sequence: Synthetic oligonucleotide"
auggauuccagaguccagg

SEQ ID NO: 5739 - RNA, 19 nt, Artificial Sequence
  source: /note="Description of Artificial Sequence: Synthetic oligonucleotide"
uugggguccaccacuagcc

SEQ ID NO: 5740 - RNA, 19 nt, Artificial Sequence
  source: /note="Description of Artificial Sequence: Synthetic oligonucleotide"
aaggagcugugguaguggc

SEQ ID NO: 5741 - RNA, 19 nt, Artificial Sequence
  source: /note="Description of Artificial Sequence: Synthetic oligonucleotide"
uuuaccacucagagaagga

SEQ ID NO: 5742 - RNA, 19 nt, Artificial Sequence
  source: /note="Description of Artificial Sequence: Synthetic oligonucleotide"
uugccuuuaccacucagag

SEQ ID NO: 5743 - RNA, 19 nt, Artificial Sequence
  source: /note="Description of Artificial Sequence: Synthetic oligonucleotide"
uuccucaggauugccuuua

SEQ ID NO: 5744 - RNA, 19 nt, Artificial Sequence
  source: /note="Description of Artificial Sequence: Synthetic oligonucleotide"
auccucuuccucaggauug

SEQ ID NO: 5745 - RNA, 19 nt, Artificial Sequence
  source: /note="Description of Artificial Sequence: Synthetic oligonucleotide"
auccacauccucuuccuca

SEQ ID NO: 5746 - RNA, 19 nt, Artificial Sequence
  source: /note="Description of Artificial Sequence: Synthetic oligonucleotide"
uacaggacuugggagguau

SEQ ID NO: 5747 - RNA, 19 nt, Artificial Sequence
  source: /note="Description of Artificial Sequence: Synthetic oligonucleotide"
auacaggacuugggaggua

SEQ ID NO: 5748 - RNA, 19 nt, Artificial Sequence
  source: /note="Description of Artificial Sequence: Synthetic oligonucleotide"
uucccacucauacaggacu

SEQ ID NO: 5749 - RNA, 19 nt, Artificial Sequence
  source: /note="Description of Artificial Sequence: Synthetic oligonucleotide"
aucccuguucccacucaua

SEQ ID NO: 5750 - RNA, 19 nt, Artificial Sequence
  source: /note="Description of Artificial Sequence: Synthetic oligonucleotide"
uuauauuuacuaaagcuug

SEQ ID NO: 5751 - RNA, 19 nt, Artificial Sequence
  source: /note="Description of Artificial Sequence: Synthetic oligonucleotide"
auuauauuuacuaaagcuu

SEQ ID NO: 5752 - RNA, 19 nt, Artificial Sequence
  source: /note="Description of Artificial Sequence: Synthetic oligonucleotide"
aaaucccuguucccacuca

SEQ ID NO: 5753 - RNA, 19 nt, Artificial Sequence
  source: /note="Description of Artificial Sequence: Synthetic oligonucleotide"
aaaaucccuguucccacuc

SEQ ID NO: 5754 - RNA, 19 nt, Artificial Sequence
  source: /note="Description of Artificial Sequence: Synthetic oligonucleotide"
aaggacugagaaaaucccu

SEQ ID NO: 5755 - RNA, 19 nt, Artificial Sequence
  source: /note="Description of Artificial Sequence: Synthetic oligonucleotide"
uugagugaaggacugagaa

SEQ ID NO: 5756 - RNA, 19 nt, Artificial Sequence
  source: /note="Description of Artificial Sequence: Synthetic oligonucleotide"
uucuugagugaaggacuga

SEQ ID NO: 5757 - RNA, 19 nt, Artificial Sequence
  source: /note="Description of Artificial Sequence: Synthetic oligonucleotide"
uacuuguucuugagugaag

SEQ ID NO: 5758 - RNA, 19 nt, Artificial Sequence
  source: /note="Description of Artificial Sequence: Synthetic oligonucleotide"
aucagcuacuuguucuuga

SEQ ID NO: 5759 - RNA, 19 nt, Artificial Sequence
  source: /note="Description of Artificial Sequence: Synthetic oligonucleotide"
uacuguccaucaauaucag

SEQ ID NO: 5760 - RNA, 19 nt, Artificial Sequence
  source: /note="Description of Artificial Sequence: Synthetic oligonucleotide"
uugcauacuguccaucaau

SEQ ID NO: 5761 - RNA, 19 nt, Artificial Sequence
  source: /note="Description of Artificial Sequence: Synthetic oligonucleotide"
uacccucugagcucgaguc

SEQ ID NO: 5762 - RNA, 19 nt, Artificial Sequence
  source: /note="Description of Artificial Sequence: Synthetic oligonucleotide"
uagcagcucguacccucug

SEQ ID NO: 5763 - RNA, 19 nt, Artificial Sequence
  source: /note="Description of Artificial Sequence: Synthetic oligonucleotide"
auagcagcucguacccucu

SEQ ID NO: 5764 - RNA, 19 nt, Artificial Sequence
  source: /note="Description of Artificial Sequence: Synthetic oligonucleotide"
aacauagcagcucguaccc

SEQ ID NO: 5765 - RNA, 19 nt, Artificial Sequence
  source: /note="Description of Artificial Sequence: Synthetic oligonucleotide"
aaugucucagggaacauag

SEQ ID NO: 5766 - RNA, 19 nt, Artificial Sequence
  source: /note="Description of Artificial Sequence: Synthetic oligonucleotide"
uaaugucucagggaacaua

SEQ ID NO: 5767 - RNA, 19 nt, Artificial Sequence
  source: /note="Description of Artificial Sequence: Synthetic oligonucleotide"
aucuaaugucucagggaac

SEQ ID NO: 5768 - RNA, 19 nt, Artificial Sequence
  source: /note="Description of Artificial Sequence: Synthetic oligonucleotide"
aucugcaugcccucaucua

SEQ ID NO: 5769 - RNA, 19 nt, Artificial Sequence
  source: /note="Description of Artificial Sequence: Synthetic oligonucleotide"
augggaucugcaugcccuc

SEQ ID NO: 5770 - RNA, 19 nt, Artificial Sequence
  source: /note="Description of Artificial Sequence: Synthetic oligonucleotide"
uagaugggaucugcaugcc

SEQ ID NO: 5771 - RNA, 19 nt, Artificial Sequence
  source: /note="Description of Artificial Sequence: Synthetic oligonucleotide"
aacuguguagaugggaucu

SEQ ID NO: 5772 - RNA, 19 nt, Artificial Sequence
  source: /note="Description of Artificial Sequence: Synthetic oligonucleotide"
aucaaacuguguagauggg

SEQ ID NO: 5773 - RNA, 19 nt, Artificial Sequence
  source: /note="Description of Artificial Sequence: Synthetic oligonucleotide"
augagcagcaucaaacugu

SEQ ID NO: 5774 - RNA, 19 nt, Artificial Sequence
  source: /note="Description of Artificial Sequence: Synthetic oligonucleotide"
uagugggaugagcagcauc

SEQ ID NO: 5775 - RNA, 19 nt, Artificial Sequence
  source: /note="Description of Artificial Sequence: Synthetic oligonucleotide"
uuagugggaugagcagcau

SEQ ID NO: 5776 - RNA, 19 nt, Artificial Sequence
  source: /note="Description of Artificial Sequence: Synthetic oligonucleotide"
auuagugggaugagcagca

SEQ ID NO: 5777 - RNA, 19 nt, Artificial Sequence
  source: /note="Description of Artificial Sequence: Synthetic oligonucleotide"
aacgcuggacauuaguggg

SEQ ID NO: 5778 - RNA, 19 nt, Artificial Sequence
  source: /note="Description of Artificial Sequence: Synthetic oligonucleotide"
augguucagccaaacgcug

SEQ ID NO: 5779 - RNA, 19 nt, Artificial Sequence
  source: /note="Description of Artificial Sequence: Synthetic oligonucleotide"
aucugugaugguucagcca

SEQ ID NO: 5780 - RNA, 19 nt, Artificial Sequence
  source: /note="Description of Artificial Sequence: Synthetic oligonucleotide"
uucagcaucugugaugguu

SEQ ID NO: 5781 - RNA, 19 nt, Artificial Sequence
  source: /note="Description of Artificial Sequence: Synthetic oligonucleotide"
uuucagcaucugugauggu

SEQ ID NO: 5782 - RNA, 19 nt, Artificial Sequence
  source: /note="Description of Artificial Sequence: Synthetic oligonucleotide"
auguuucagcaucugugau

SEQ ID NO: 5783 - RNA, 19 nt, Artificial Sequence
  source: /note="Description of Artificial Sequence: Synthetic oligonucleotide"
aacugcauguuucagcauc

SEQ ID NO: 5784 - RNA, 19 nt, Artificial Sequence
  source: /note="Description of Artificial Sequence: Synthetic oligonucleotide"
uuacaacugcauguuucag

SEQ ID NO: 5785 - RNA, 19 nt, Artificial Sequence
  source: /note="Description of Artificial Sequence: Synthetic oligonucleotide"
aaguuuacaacugcauguu

SEQ ID NO: 5786 - RNA, 19 nt, Artificial Sequence
  source: /note="Description of Artificial Sequence: Synthetic oligonucleotide"
aucaaguuuacaacugcau

SEQ ID NO: 5787 - RNA, 19 nt, Artificial Sequence
  source: /note="Description of Artificial Sequence: Synthetic oligonucleotide"
aaucaaguuuacaacugca

SEQ ID NO: 5788 - RNA, 19 nt, Artificial Sequence
  source: /note="Description of Artificial Sequence: Synthetic oligonucleotide"
uuaaucaaguuuacaacug

SEQ ID NO: 5789 - RNA, 19 nt, Artificial Sequence
  source: /note="Description of Artificial Sequence: Synthetic oligonucleotide"
aucuugauaguuaaucaag

SEQ ID NO: 5790 - RNA, 19 nt, Artificial Sequence
  source: /note="Description of Artificial Sequence: Synthetic oligonucleotide"
aucaucuugauaguuaauc

SEQ ID NO: 5791 - RNA, 19 nt, Artificial Sequence
  source: /note="Description of Artificial Sequence: Synthetic oligonucleotide"
uucugcaucaucuugauag

SEQ ID NO: 5792 - RNA, 19 nt, Artificial Sequence
  source: /note="Description of Artificial Sequence: Synthetic oligonucleotide"
uugcacguguggcaaguuc

SEQ ID NO: 5793 - RNA, 19 nt, Artificial Sequence
  source: /note="Description of Artificial Sequence: Synthetic oligonucleotide"
auugcacguguggcaaguu

SEQ ID NO: 5794 - RNA, 19 nt, Artificial Sequence
  source: /note="Description of Artificial Sequence: Synthetic oligonucleotide"
uucagggauugcacgugug

SEQ ID NO: 5795 - RNA, 19 nt, Artificial Sequence
  source: /note="Description of Artificial Sequence: Synthetic oligonucleotide"
uugucaguucagggauugc

SEQ ID NO: 5796 - RNA, 19 nt, Artificial Sequence
  source: /note="Description of Artificial Sequence: Synthetic oligonucleotide"
uuugucaguucagggauug

SEQ ID NO: 5797 - RNA, 19 nt, Artificial Sequence
  source: /note="Description of Artificial Sequence: Synthetic oligonucleotide"
uuuugucaguucagggauu

SEQ ID NO: 5798 - RNA, 19 nt, Artificial Sequence
  source: /note="Description of Artificial Sequence: Synthetic oligonucleotide"
uagcaguuuugucaguuca

SEQ ID NO: 5799 - RNA, 19 nt, Artificial Sequence
  source: /note="Description of Artificial Sequence: Synthetic oligonucleotide"
uuagcaguuuugucaguuc

SEQ ID NO: 5800 - RNA, 19 nt, Artificial Sequence
  source: /note="Description of Artificial Sequence: Synthetic oligonucleotide"
uuuagcaguuuugucaguu

SEQ ID NO: 5801 - RNA, 19 nt, Artificial Sequence
  source: /note="Description of Artificial Sequence: Synthetic oligonucleotide"
auuuagcaguuuugucagu

SEQ ID NO: 5802 - RNA, 19 nt, Artificial Sequence
  source: /note="Description of Artificial Sequence: Synthetic oligonucleotide"
uaaccaccaccugguccuc

SEQ ID NO: 5803 - RNA, 19 nt, Artificial Sequence
  source: /note="Description of Artificial Sequence: Synthetic oligonucleotide"
uuaaccaccaccugguccu

SEQ ID NO: 5804 - RNA, 19 nt, Artificial Sequence
  source: /note="Description of Artificial Sequence: Synthetic oligonucleotide"
auuaaccaccaccuggucc

SEQ ID NO: 5805 - RNA, 19 nt, Artificial Sequence
  source: /note="Description of Artificial Sequence: Synthetic oligonucleotide"
uauuaaccaccaccugguc

SEQ ID NO: 5806 - RNA, 19 nt, Artificial Sequence
  source: /note="Description of Artificial Sequence: Synthetic oligonucleotide"
uuauaauuauugcaaguga

SEQ ID NO: 5807 - RNA, 19 nt, Artificial Sequence
  source: /note="Description of Artificial Sequence: Synthetic oligonucleotide"
uucuuauaauuauugcaag

SEQ ID NO: 5808 - RNA, 19 nt, Artificial Sequence
  source: /note="Description of Artificial Sequence: Synthetic oligonucleotide"
uuauuaaccaccaccuggu

SEQ ID NO: 5809 - RNA, 19 nt, Artificial Sequence
  source: /note="Description of Artificial Sequence: Synthetic oligonucleotide"
auggaccauaacugcagcc

SEQ ID NO: 5810 - RNA, 19 nt, Artificial Sequence
  source: /note="Description of Artificial Sequence: Synthetic oligonucleotide"
aaagcugauggaccauaac

SEQ ID NO: 5811 - RNA, 19 nt, Artificial Sequence
  source: /note="Description of Artificial Sequence: Synthetic oligonucleotide"
uagaaagcugauggaccau

SEQ ID NO: 5812 - RNA, 19 nt, Artificial Sequence
  source: /note="Description of Artificial Sequence: Synthetic oligonucleotide"
uuagaaagcugauggacca

SEQ ID NO: 5813 - RNA, 19 nt, Artificial Sequence
  source: /note="Description of Artificial Sequence: Synthetic oligonucleotide"
uucccugucaccagcccga

SEQ ID NO: 5814 - RNA, 19 nt, Artificial Sequence
  source: /note="Description of Artificial Sequence: Synthetic oligonucleotide"
uuuagaaagcugauggacc

SEQ ID NO: 5815 - RNA, 19 nt, Artificial Sequence
  source: /note="Description of Artificial Sequence: Synthetic oligonucleotide"
uuuuagaaagcugauggac

SEQ ID NO: 5816 - RNA, 19 nt, Artificial Sequence
  source: /note="Description of Artificial Sequence: Synthetic oligonucleotide"
uagcgugucuggaagcuuc

SEQ ID NO: 5817 - RNA, 19 nt, Artificial Sequence
  source: /note="Description of Artificial Sequence: Synthetic oligonucleotide"
auagcgugucuggaagcuu

SEQ ID NO: 5818 - RNA, 19 nt, Artificial Sequence
  source: /note="Description of Artificial Sequence: Synthetic oligonucleotide"
augauagcgugucuggaag

SEQ ID NO: 5819 - RNA, 19 nt, Artificial Sequence
  source: /note="Description of Artificial Sequence: Synthetic oligonucleotide"
aacgcaugauagcgugucu

SEQ ID NO: 5820 - RNA, 19 nt, Artificial Sequence
  source: /note="Description of Artificial Sequence: Synthetic oligonucleotide"
aucugaggagaacgcauga

SEQ ID NO: 5821 - RNA, 19 nt, Artificial Sequence
  source: /note="Description of Artificial Sequence: Synthetic oligonucleotide"
uagcagacaccaucugagg

SEQ ID NO: 5822 - RNA, 19 nt, Artificial Sequence
  source: /note="Description of Artificial Sequence: Synthetic oligonucleotide"
auagcagacaccaucugag

SEQ ID NO: 5823 - RNA, 19 nt, Artificial Sequence
  source: /note="Description of Artificial Sequence: Synthetic oligonucleotide"
uacguacaauagcagacac

SEQ ID NO: 5824 - RNA, 19 nt, Artificial Sequence
  source: /note="Description of Artificial Sequence: Synthetic oligonucleotide"
augguacguacaauagcag

SEQ ID NO: 5825 - RNA, 19 nt, Artificial Sequence
  source: /note="Description of Artificial Sequence: Synthetic oligonucleotide"
uucugcaugguacguacaa

SEQ ID NO: 5826 - RNA, 19 nt, Artificial Sequence
  source: /note="Description of Artificial Sequence: Synthetic oligonucleotide"
auucugcaugguacguaca

SEQ ID NO: 5827 - RNA, 19 nt, Artificial Sequence
  source: /note="Description of Artificial Sequence: Synthetic oligonucleotide"
uuguauucugcaugguacg

SEQ ID NO: 5828 - RNA, 19 nt, Artificial Sequence
  source: /note="Description of Artificial Sequence: Synthetic oligonucleotide"
aucauuuguauucugcaug

SEQ ID NO: 5829 - RNA, 19 nt, Artificial Sequence
  source: /note="Description of Artificial Sequence: Synthetic oligonucleotide"
uacaucauuuguauucugc

SEQ ID NO: 5830 - RNA, 19 nt, Artificial Sequence
  source: /note="Description of Artificial Sequence: Synthetic oligonucleotide"
uucuacaucauuuguauuc

SEQ ID NO: 5831 - RNA, 19 nt, Artificial Sequence
  source: /note="Description of Artificial Sequence: Synthetic oligonucleotide"
aacgagcuguuucuacauc

SEQ ID NO: 5832 - RNA, 19 nt, Artificial Sequence
  source: /note="Description of Artificial Sequence: Synthetic oligonucleotide"
aaggucccagcgguacaac

SEQ ID NO: 5833 - RNA, 19 nt, Artificial Sequence
  source: /note="Description of Artificial Sequence: Synthetic oligonucleotide"
augcaaggucccagcggua

SEQ ID NO: 5834 - RNA, 19 nt, Artificial Sequence
  source: /note="Description of Artificial Sequence: Synthetic oligonucleotide"
uuaugcaaggucccagcgg

SEQ ID NO: 5835 - RNA, 19 nt, Artificial Sequence
  source: /note="Description of Artificial Sequence: Synthetic oligonucleotide"
aagguuaugcaagguccca

SEQ ID NO: 5836 - RNA, 19 nt, Artificial Sequence
  source: /note="Description of Artificial Sequence: Synthetic oligonucleotide"
aaagguuaugcaagguccc

SEQ ID NO: 5837 - RNA, 19 nt, Artificial Sequence
  source: /note="Description of Artificial Sequence: Synthetic oligonucleotide"
augggaaagguuaugcaag

SEQ ID NO: 5838 - RNA, 19 nt, Artificial Sequence
  source: /note="Description of Artificial Sequence: Synthetic oligonucleotide"
augccuccagacuuaaaga

SEQ ID NO: 5839 - RNA, 19 nt, Artificial Sequence
  source: /note="Description of Artificial Sequence: Synthetic oligonucleotide"
uucaccagggcaggaaugc

SEQ ID NO: 5840 - RNA, 19 nt, Artificial Sequence
  source: /note="Description of Artificial Sequence: Synthetic oligonucleotide"
uuucaccagggcaggaaug

SEQ ID NO: 5841 - RNA, 19 nt, Artificial Sequence
  source: /note="Description of Artificial Sequence: Synthetic oligonucleotide"
uuuucaccagggcaggaau

SEQ ID NO: 5842 - RNA, 19 nt, Artificial Sequence
  source: /note="Description of Artificial Sequence: Synthetic oligonucleotide"
auuuucaccagggcaggaa

SEQ ID NO: 5843 - RNA, 19 nt, Artificial Sequence
  source: /note="Description of Artificial Sequence: Synthetic oligonucleotide"
aagcauuuucaccagggca

SEQ ID NO: 5844 - RNA, 19 nt, Artificial Sequence
  source: /note="Description of Artificial Sequence: Synthetic oligonucleotide"
aaccaagcauuuucaccag

SEQ ID NO: 5845 - RNA, 19 nt, Artificial Sequence
  source: /note="Description of Artificial Sequence: Synthetic oligonucleotide"
auccacuggugaaccaagc

SEQ ID NO: 5846 - RNA, 19 nt, Artificial Sequence
  source: /note="Description of Artificial Sequence: Synthetic oligonucleotide"
aauccacuggugaaccaag

SEQ ID NO: 5847 - RNA, 19 nt, Artificial Sequence
  source: /note="Description of Artificial Sequence: Synthetic oligonucleotide"
auggcacccugcucacgca

SEQ ID NO: 5848 - RNA, 19 nt, Artificial Sequence
  source: /note="Description of Artificial Sequence: Synthetic oligonucleotide"
aauggcacccugcucacgc

SEQ ID NO: 5849 - RNA, 19 nt, Artificial Sequence
  source: /note="Description of Artificial Sequence: Synthetic oligonucleotide"
aacacagaauccacuggug

SEQ ID NO: 5850 - RNA, 19 nt, Artificial Sequence
  source: /note="Description of Artificial Sequence: Synthetic oligonucleotide"
aacaacacagaauccacug

SEQ ID NO: 5851 - RNA, 19 nt, Artificial Sequence
  source: /note="Description of Artificial Sequence: Synthetic oligonucleotide"
aaacaacacagaauccacu

SEQ ID NO: 5852 - RNA, 19 nt, Artificial Sequence
  source: /note="Description of Artificial Sequence: Synthetic oligonucleotide"
aaaacaacacagaauccac

SEQ ID NO: 5853 - RNA, 19 nt, Artificial Sequence
  source: /note="Description of Artificial Sequence: Synthetic oligonucleotide"
uaaaacaacacagaaucca

SEQ ID NO: 5854 - RNA, 19 nt, Artificial Sequence
  source: /note="Description of Artificial Sequence: Synthetic oligonucleotide"
auaaaacaacacagaaucc

SEQ ID NO: 5855 - RNA, 19 nt, Artificial Sequence
  source: /note="Description of Artificial Sequence: Synthetic oligonucleotide"
aauggcauaaaacaacaca

SEQ ID NO: 5856 - RNA, 19 nt, Artificial Sequence
  source: /note="Description of Artificial Sequence: Synthetic oligonucleotide"
uugcugcugugucccaccc

SEQ ID NO: 5857 - RNA, 19 nt, Artificial Sequence
  source: /note="Description of Artificial Sequence: Synthetic oligonucleotide"
uaauggcauaaaacaacac

SEQ ID NO: 5858 - RNA, 19 nt, Artificial Sequence
  source: /note="Description of Artificial Sequence: Synthetic oligonucleotide"
uuguaauggcauaaaacaa

SEQ ID NO: 5859 - RNA, 19 nt, Artificial Sequence
  source: /note="Description of Artificial Sequence: Synthetic oligonucleotide"
uuguggagaguuguaaugg

SEQ ID NO: 5860 - RNA, 19 nt, Artificial Sequence
  source: /note="Description of Artificial Sequence: Synthetic oligonucleotide"
aagguuguggagaguugua

SEQ ID NO: 5861 - RNA, 19 nt, Artificial Sequence
  source: /note="Description of Artificial Sequence: Synthetic oligonucleotide"
aaagguuguggagaguugu

SEQ ID NO: 5862 - RNA, 19 nt, Artificial Sequence
  source: /note="Description of Artificial Sequence: Synthetic oligonucleotide"
aaaagguuguggagaguug

SEQ ID NO: 5863 - RNA, 19 nt, Artificial Sequence
  source: /note="Description of Artificial Sequence: Synthetic oligonucleotide"
uaaaagguuguggagaguu

SEQ ID NO: 5864 - RNA, 19 nt, Artificial Sequence
  source: /note="Description of Artificial Sequence: Synthetic oligonucleotide"
auaaaagguuguggagagu

SEQ ID NO: 5865 - RNA, 19 nt, Artificial Sequence
  source: /note="Description of Artificial Sequence: Synthetic oligonucleotide"
aauaaaagguuguggagag

SEQ ID NO: 5866 - RNA, 19 nt, Artificial Sequence
  source: /note="Description of Artificial Sequence: Synthetic oligonucleotide"
uaauaaaagguuguggaga

SEQ ID NO: 5867 - RNA, 19 nt, Artificial Sequence
  source: /note="Description of Artificial Sequence: Synthetic oligonucleotide"
uugauguaauaaaagguug

SEQ ID NO: 5868 - RNA, 19 nt, Artificial Sequence
  source: /note="Description of Artificial Sequence: Synthetic oligonucleotide"
uucuugauguaauaaaagg

SEQ ID NO: 5869 - RNA, 19 nt, Artificial Sequence
  source: /note="Description of Artificial Sequence: Synthetic oligonucleotide"
uagcuccuucuugauguaa

SEQ ID NO: 5870 - RNA, 19 nt, Artificial Sequence
  source: /note="Description of Artificial Sequence: Synthetic oligonucleotide"
uuagcuccuucuugaugua

SEQ ID NO: 5871 - RNA, 19 nt, Artificial Sequence
  source: /note="Description of Artificial Sequence: Synthetic oligonucleotide"
uuuuagcuccuucuugaug

SEQ ID NO: 5872 - RNA, 19 nt, Artificial Sequence
  source: /note="Description of Artificial Sequence: Synthetic oligonucleotide"
auuuuagcuccuucuugau

SEQ ID NO: 5873 - RNA, 19 nt, Artificial Sequence
  source: /note="Description of Artificial Sequence: Synthetic oligonucleotide"
aacgcacugccauuuuagc

SEQ ID NO: 5874 - RNA, 19 nt, Artificial Sequence
  source: /note="Description of Artificial Sequence: Synthetic oligonucleotide"
uaaacgcacugccauuuua

SEQ ID NO: 5875 - RNA, 19 nt, Artificial Sequence
  source: /note="Description of Artificial Sequence: Synthetic oligonucleotide"
uugagcaaggcaaccauuu

SEQ ID NO: 5876 - RNA, 19 nt, Artificial Sequence
  source: /note="Description of Artificial Sequence: Synthetic oligonucleotide"
uacccucaggggaacaggc

SEQ ID NO: 5877 - RNA, 19 nt, Artificial Sequence
  source: /note="Description of Artificial Sequence: Synthetic oligonucleotide"
uuguugagcaaggcaacca

SEQ ID NO: 5878 - RNA, 19 nt, Artificial Sequence
  source: /note="Description of Artificial Sequence: Synthetic oligonucleotide"
uuuguugagcaaggcaacc

SEQ ID NO: 5879 - RNA, 19 nt, Artificial Sequence
  source: /note="Description of Artificial Sequence: Synthetic oligonucleotide"
uuuuguugagcaaggcaac

SEQ ID NO: 5880 - RNA, 19 nt, Artificial Sequence
  source: /note="Description of Artificial Sequence: Synthetic oligonucleotide"
uuguuuuguugagcaaggc

SEQ ID NO: 5881 - RNA, 19 nt, Artificial Sequence
  source: /note="Description of Artificial Sequence: Synthetic oligonucleotide"
uuuguuuuguugagcaagg

SEQ ID NO: 5882 - RNA, 19 nt, Artificial Sequence
  source: /note="Description of Artificial Sequence: Synthetic oligonucleotide"
uaauagccaagaauuuaac

SEQ ID NO: 5883 - RNA, 19 nt, Artificial Sequence
  source: /note="Description of Artificial Sequence: Synthetic oligonucleotide"
aaggcagucugucguaaua

SEQ ID NO: 5884 - RNA, 19 nt, Artificial Sequence
  source: /note="Description of Artificial Sequence: Synthetic oligonucleotide"
uugcuuucuugguugccau

SEQ ID NO: 5885 - RNA, 19 nt, Artificial Sequence
  source: /note="Description of Artificial Sequence: Synthetic oligonucleotide"
aagcuugggguccaccacu

SEQ ID NO: 5886 - RNA, 19 nt, Artificial Sequence
  source: /note="Description of Artificial Sequence: Synthetic oligonucleotide"
aaagcuugggguccaccac

SEQ ID NO: 5887 - RNA, 19 nt, Artificial Sequence
  source: /note="Description of Artificial Sequence: Synthetic oligonucleotide"
uaaagcuugggguccacca

SEQ ID NO: 5888 - RNA, 19 nt, Artificial Sequence
  source: /note="Description of Artificial Sequence: Synthetic oligonucleotide"
uacuaaagcuuggggucca

SEQ ID NO: 5889 - RNA, 19 nt, Artificial Sequence
  source: /note="Description of Artificial Sequence: Synthetic oligonucleotide"
uuacuaaagcuuggggucc

SEQ ID NO: 5890 - RNA, 19 nt, Artificial Sequence
  source: /note="Description of Artificial Sequence: Synthetic oligonucleotide"
uuuacuaaagcuugggguc

SEQ ID NO: 5891 - RNA, 19 nt, Artificial Sequence
  source: /note="Description of Artificial Sequence: Synthetic oligonucleotide"
auuuacuaaagcuuggggu

SEQ ID NO: 5892 - RNA, 19 nt, Artificial Sequence
  source: /note="Description of Artificial Sequence: Synthetic oligonucleotide"
uauuuacuaaagcuugggg

SEQ ID NO: 5893 - RNA, 19 nt, Artificial Sequence
  source: /note="Description of Artificial Sequence: Synthetic oligonucleotide"
auauuuacuaaagcuuggg

SEQ ID NO: 5894 - RNA, 19 nt, Artificial Sequence
  source: /note="Description of Artificial Sequence: Synthetic oligonucleotide"
uauauuuacuaaagcuugg

SEQ ID NO: 5895 - RNA, 19 nt, Artificial Sequence
  source: /note="Description of Artificial Sequence: Synthetic oligonucleotide"
uagguccucauuauauuua

SEQ ID NO: 5896 - RNA, 19 nt, Artificial Sequence
  source: /note="Description of Artificial Sequence: Synthetic oligonucleotide"
auagguccucauuauauuu

SEQ ID NO: 5897 - RNA, 19 nt, Artificial Sequence
  source: /note="Description of Artificial Sequence: Synthetic oligonucleotide"
uauagguccucauuauauu

SEQ ID NO: 5898 - RNA, 19 nt, Artificial Sequence
  source: /note="Description of Artificial Sequence: Synthetic oligonucleotide"
aaguauagguccucauuau

SEQ ID NO: 5899 - RNA, 19 nt, Artificial Sequence
  source: /note="Description of Artificial Sequence: Synthetic oligonucleotide"
uugugguccacaguaguuu

SEQ ID NO: 5900 - RNA, 19 nt, Artificial Sequence
  source: /note="Description of Artificial Sequence: Synthetic oligonucleotide"
uucagcacucugcuugugg

SEQ ID NO: 5901 - RNA, 19 nt, Artificial Sequence
  source: /note="Description of Artificial Sequence: Synthetic oligonucleotide"
uagcaccuucagcacucug

SEQ ID NO: 5902 - RNA, 19 nt, Artificial Sequence
  source: /note="Description of Artificial Sequence: Synthetic oligonucleotide"
auagcaccuucagcacucu

SEQ ID NO: 5903 - RNA, 19 nt, Artificial Sequence
  source: /note="Description of Artificial Sequence: Synthetic oligonucleotide"
uuccaccagcuucuacaau

SEQ ID NO: 5904 - RNA, 19 nt, Artificial Sequence
  source: /note="Description of Artificial Sequence: Synthetic oligonucleotide"
auuccaccagcuucuacaa

SEQ ID NO: 5905 - RNA, 19 nt, Artificial Sequence
  source: /note="Description of Artificial Sequence: Synthetic oligonucleotide"
aagcuugcauuccaccagc

SEQ ID NO: 5906 - RNA, 19 nt, Artificial Sequence
  source: /note="Description of Artificial Sequence: Synthetic oligonucleotide"
aaagcuugcauuccaccag

SEQ ID NO: 5907 - RNA, 19 nt, Artificial Sequence
  source: /note="Description of Artificial Sequence: Synthetic oligonucleotide"
aucugucaggugaaguccu

SEQ ID NO: 5908 - RNA, 19 nt, Artificial Sequence
  source: /note="Description of Artificial Sequence: Synthetic oligonucleotide"
uuggaucugucaggugaag

SEQ ID NO: 5909 - RNA, 19 nt, Artificial Sequence
  source: /note="Description of Artificial Sequence: Synthetic oligonucleotide"
uugacuuggaucugucagg

SEQ ID NO: 5910 - RNA, 19 nt, Artificial Sequence
  source: /note="Description of Artificial Sequence: Synthetic oligonucleotide"
aagacguugacuuggaucu

SEQ ID NO: 5911 - RNA, 19 nt, Artificial Sequence
  source: /note="Description of Artificial Sequence: Synthetic oligonucleotide"
aacaagacguugacuugga

SEQ ID NO: 5912 - RNA, 19 nt, Artificial Sequence
  source: /note="Description of Artificial Sequence: Synthetic oligonucleotide"
aagacaguucugaacaaga

SEQ ID NO: 5913 - RNA, 19 nt, Artificial Sequence
  source: /note="Description of Artificial Sequence: Synthetic oligonucleotide"
aaagacaguucugaacaag

SEQ ID NO: 5914 - RNA, 19 nt, Artificial Sequence
  source: /note="Description of Artificial Sequence: Synthetic oligonucleotide"
uuccugagaguccaaagac

SEQ ID NO: 5915 - RNA, 19 nt, Artificial Sequence
  source: /note="Description of Artificial Sequence: Synthetic oligonucleotide"
auuccugagaguccaaaga

SEQ ID NO: 5916 - RNA, 19 nt, Artificial Sequence
  source: /note="Description of Artificial Sequence: Synthetic oligonucleotide"
aagauuccugagaguccaa

SEQ ID NO: 5917 - RNA, 19 nt, Artificial Sequence
  source: /note="Description of Artificial Sequence: Synthetic oligonucleotide"
aagggguucucccugggca

SEQ ID NO: 5918 - RNA, 19 nt, Artificial Sequence
  source: /note="Description of Artificial Sequence: Synthetic oligonucleotide"
aaagauuccugagagucca

SEQ ID NO: 5919 - RNA, 19 nt, Artificial Sequence
  source: /note="Description of Artificial Sequence: Synthetic oligonucleotide"
aucugaaagauuccugaga

SEQ ID NO: 5920 - RNA, 19 nt, Artificial Sequence
  source: /note="Description of Artificial Sequence: Synthetic oligonucleotide"
uugcagcaucugaaagauu

SEQ ID NO: 5921 - RNA, 19 nt, Artificial Sequence
  source: /note="Description of Artificial Sequence: Synthetic oligonucleotide"
uaguugcagcaucugaaag

SEQ ID NO: 5922 - RNA, 19 nt, Artificial Sequence
  source: /note="Description of Artificial Sequence: Synthetic oligonucleotide"
uuuaguugcagcaucugaa

SEQ ID NO: 5923 - RNA, 19 nt, Artificial Sequence
  source: /note="Description of Artificial Sequence: Synthetic oligonucleotide"
uuccuguuuaguugcagca

SEQ ID NO: 5924 - RNA, 19 nt, Artificial Sequence
  source: /note="Description of Artificial Sequence: Synthetic oligonucleotide"
uuccaucccuuccuguuua

SEQ ID NO: 5925 - RNA, 19 nt, Artificial Sequence
  source: /note="Description of Artificial Sequence: Synthetic oligonucleotide"
aaggagaccuuccaucccu

SEQ ID NO: 5926 - RNA, 19 nt, Artificial Sequence
  source: /note="Description of Artificial Sequence: Synthetic oligonucleotide"
aagagucccaaggagaccu

SEQ ID NO: 5927 - RNA, 19 nt, Artificial Sequence
  source: /note="Description of Artificial Sequence: Synthetic oligonucleotide"
aacaagagucccaaggaga

SEQ ID NO: 5928 - RNA, 19 nt, Artificial Sequence
  source: /note="Description of Artificial Sequence: Synthetic oligonucleotide"
aagcugaacaagaguccca

SEQ ID NO: 5929 - RNA, 19 nt, Artificial Sequence
  source: /note="Description of Artificial Sequence: Synthetic oligonucleotide"
aacccagaagcugaacaag

SEQ ID NO: 5930 - RNA, 19 nt, Artificial Sequence
  source: /note="Description of Artificial Sequence: Synthetic oligonucleotide"
aucugaacccagaagcuga

SEQ ID NO: 5931 - RNA, 19 nt, Artificial Sequence
  source: /note="Description of Artificial Sequence: Synthetic oligonucleotide"
aucaucugaacccagaagc

SEQ ID NO: 5932 - RNA, 19 nt, Artificial Sequence
  source: /note="Description of Artificial Sequence: Synthetic oligonucleotide"
uaucaucugaacccagaag

SEQ ID NO: 5933 - RNA, 19 nt, Artificial Sequence
  source: /note="Description of Artificial Sequence: Synthetic oligonucleotide"
uacccaaggcauccuggcc

SEQ ID NO: 5934 - RNA, 19 nt, Artificial Sequence
  source: /note="Description of Artificial Sequence: Synthetic oligonucleotide"
auaucaucugaacccagaa

SEQ ID NO: 5935 - RNA, 19 nt, Artificial Sequence
  source: /note="Description of Artificial Sequence: Synthetic oligonucleotide"
uuauaucaucugaacccag

SEQ ID NO: 5936 - RNA, 19 nt, Artificial Sequence
  source: /note="Description of Artificial Sequence: Synthetic oligonucleotide"
uuuauaucaucugaaccca

SEQ ID NO: 5937 - RNA, 19 nt, Artificial Sequence
  source: /note="Description of Artificial Sequence: Synthetic oligonucleotide"
uuccagcugcacaggugac

SEQ ID NO: 5938 - RNA, 19 nt, Artificial Sequence
  source: /note="Description of Artificial Sequence: Synthetic oligonucleotide"
auuccagcugcacagguga

SEQ ID NO: 5939 - RNA, 19 nt, Artificial Sequence
  source: /note="Description of Artificial Sequence: Synthetic oligonucleotide"
aauuccagcugcacaggug

SEQ ID NO: 5940 - RNA, 19 nt, Artificial Sequence
  source: /note="Description of Artificial Sequence: Synthetic oligonucleotide"
aagaauuccagcugcacag

SEQ ID NO: 5941 - RNA, 19 nt, Artificial Sequence
  source: /note="Description of Artificial Sequence: Synthetic oligonucleotide"
aaagaauuccagcugcaca

SEQ ID NO: 5942 - RNA, 19 nt, Artificial Sequence
  source: /note="Description of Artificial Sequence: Synthetic oligonucleotide"
uagaaagaauuccagcugc

SEQ ID NO: 5943 - RNA, 19 nt, Artificial Sequence
  source: /note="Description of Artificial Sequence: Synthetic oligonucleotide"
uuagaaagaauuccagcug

SEQ ID NO: 5944 - RNA, 19 nt, Artificial Sequence
  source: /note="Description of Artificial Sequence: Synthetic oligonucleotide"
uugcaagugagguuagaaa

SEQ ID NO: 5945 - RNA, 19 nt, Artificial Sequence
  source: /note="Description of Artificial Sequence: Synthetic oligonucleotide"
auugcaagugagguuagaa

SEQ ID NO: 5946 - RNA, 19 nt, Artificial Sequence
  source: /note="Description of Artificial Sequence: Synthetic oligonucleotide"
uaauuauugcaagugaggu

SEQ ID NO: 5947 - RNA, 19 nt, Artificial Sequence
  source: /note="Description of Artificial Sequence: Synthetic oligonucleotide"
auaauuauugcaagugagg

SEQ ID NO: 5948 - RNA, 19 nt, Artificial Sequence
  source: /note="Description of Artificial Sequence: Synthetic oligonucleotide"
uauaauuauugcaagugag

SEQ ID NO: 5949 - RNA, 19 nt, Artificial Sequence
  source: /note="Description of Artificial Sequence: Synthetic oligonucleotide"
uaccacccacuuggcagac

SEQ ID NO: 5950 - RNA, 19 nt, Artificial Sequence
  source: /note="Description of Artificial Sequence: Synthetic oligonucleotide"
auaccacccacuuggcaga

SEQ ID NO: 5951 - RNA, 19 nt, Artificial Sequence
  source: /note="Description of Artificial Sequence: Synthetic oligonucleotide"
aagagccucuauaccaccc

SEQ ID NO: 5952 - RNA, 19 nt, Artificial Sequence
  source: /note="Description of Artificial Sequence: Synthetic oligonucleotide"
uacgcacaagagccucuau

SEQ ID NO: 5953 - RNA, 19 nt, Artificial Sequence
  source: /note="Description of Artificial Sequence: Synthetic oligonucleotide"
aaggacaguacgcacaaga

SEQ ID NO: 5954 - RNA, 19 nt, Artificial Sequence
  source: /note="Description of Artificial Sequence: Synthetic oligonucleotide"
augucuucccugucaccag

SEQ ID NO: 5955 - RNA, 19 nt, Artificial Sequence
  source: /note="Description of Artificial Sequence: Synthetic oligonucleotide"
auggcaggcucagugaugu

SEQ ID NO: 5956 - RNA, 19 nt, Artificial Sequence
  source: /note="Description of Artificial Sequence: Synthetic oligonucleotide"
aagagcacagauggcaggc

SEQ ID NO: 5957 - RNA, 19 nt, Artificial Sequence
  source: /note="Description of Artificial Sequence: Synthetic oligonucleotide"
uuggugucggcuggucaga

SEQ ID NO: 5958 - RNA, 19 nt, Artificial Sequence
  source: /note="Description of Artificial Sequence: Synthetic oligonucleotide"
uucuuggugucggcugguc

SEQ ID NO: 5959 - RNA, 19 nt, Artificial Sequence
  source: /note="Description of Artificial Sequence: Synthetic oligonucleotide"
aucucugcuucuugguguc

SEQ ID NO: 5960 - RNA, 19 nt, Artificial Sequence
  source: /note="Description of Artificial Sequence: Synthetic oligonucleotide"
auucugggccaucucugcu

SEQ ID NO: 5961 - RNA, 19 nt, Artificial Sequence
  source: /note="Description of Artificial Sequence: Synthetic oligonucleotide"
aacugcauucugggccauc

SEQ ID NO: 5962 - RNA, 19 nt, Artificial Sequence
  source: /note="Description of Artificial Sequence: Synthetic oligonucleotide"
aaggcgaacugcauucugg

SEQ ID NO: 5963 - RNA, 19 nt, Artificial Sequence
  source: /note="Description of Artificial Sequence: Synthetic oligonucleotide"
uagugaaggcgaacugcau

SEQ ID NO: 5964 - RNA, 19 nt, Artificial Sequence
  source: /note="Description of Artificial Sequence: Synthetic oligonucleotide"
auagugaaggcgaacugca

SEQ ID NO: 5965 - RNA, 19 nt, Artificial Sequence
  source: /note="Description of Artificial Sequence: Synthetic oligonucleotide"
uaguccauagugaaggcga

SEQ ID NO: 5966 - RNA, 19 nt, Artificial Sequence
  source: /note="Description of Artificial Sequence: Synthetic oligonucleotide"
aacugguaguccauaguga

SEQ ID NO: 5967 - RNA, 19 nt, Artificial Sequence
  source: /note="Description of Artificial Sequence: Synthetic oligonucleotide"
aaccacaacugguagucca

SEQ ID NO: 5968 - RNA, 19 nt, Artificial Sequence
  source: /note="Description of Artificial Sequence: Synthetic oligonucleotide"
uaaccacaacugguagucc

SEQ ID NO: 5969 - RNA, 19 nt, Artificial Sequence
  source: /note="Description of Artificial Sequence: Synthetic oligonucleotide"
uuaaccacaacugguaguc

SEQ ID NO: 5970 - RNA, 19 nt, Artificial Sequence
  source: /note="Description of Artificial Sequence: Synthetic oligonucleotide"
aagagcuuaaccacaacug

SEQ ID NO: 5971 - RNA, 19 nt, Artificial Sequence
  source: /note="Description of Artificial Sequence: Synthetic oligonucleotide"
uaagagcuuaaccacaacu

SEQ ID NO: 5972 - RNA, 19 nt, Artificial Sequence
  source: /note="Description of Artificial Sequence: Synthetic oligonucleotide"
augguggguguaagagcuu

SEQ ID NO: 5973 - RNA, 19 nt, Artificial Sequence
  source: /note="Description of Artificial Sequence: Synthetic oligonucleotide"
aucagaggccagugggaug

SEQ ID NO: 5974 - RNA, 19 nt, Artificial Sequence
  source: /note="Description of Artificial Sequence: Synthetic oligonucleotide"
uaucagaggccagugggau

SEQ ID NO: 5975 - RNA, 19 nt, Artificial Sequence
  source: /note="Description of Artificial Sequence: Synthetic oligonucleotide"
uuaucagaggccaguggga

SEQ ID NO: 5976 - RNA, 19 nt, Artificial Sequence
  source: /note="Description of Artificial Sequence: Synthetic oligonucleotide"
uagccuuuaucagaggcca

SEQ ID NO: 5977 - RNA, 19 nt, Artificial Sequence
  source: /note="Description of Artificial Sequence: Synthetic oligonucleotide"
aacaguagccuuuaucaga

SEQ ID NO: 5978 - RNA, 19 nt, Artificial Sequence
  source: /note="Description of Artificial Sequence: Synthetic oligonucleotide"
auccaacaguagccuuuau

SEQ ID NO: 5979 - RNA, 19 nt, Artificial Sequence
  source: /note="Description of Artificial Sequence: Synthetic oligonucleotide"
aaucaauccaacaguagcc

SEQ ID NO: 5980 - RNA, 19 nt, Artificial Sequence
  source: /note="Description of Artificial Sequence: Synthetic oligonucleotide"
auuucgaaucaauccaaca

SEQ ID NO: 5981 - RNA, 19 nt, Artificial Sequence
  source: /note="Description of Artificial Sequence: Synthetic oligonucleotide"
aacuagucguggaauggca

SEQ ID NO: 5982 - RNA, 19 nt, Artificial Sequence
  source: /note="Description of Artificial Sequence: Synthetic oligonucleotide"
aacugaacuagucguggaa

SEQ ID NO: 5983 - RNA, 19 nt, Artificial Sequence
  source: /note="Description of Artificial Sequence: Synthetic oligonucleotide"
aagcaacugaacuagucgu

SEQ ID NO: 5984 - RNA, 19 nt, Artificial Sequence
  source: /note="Description of Artificial Sequence: Synthetic oligonucleotide"
aacaagcaacugaacuagu

SEQ ID NO: 5985 - RNA, 19 nt, Artificial Sequence
  source: /note="Description of Artificial Sequence: Synthetic oligonucleotide"
augugcacgaacaagcaac

SEQ ID NO: 5986 - RNA, 19 nt, Artificial Sequence
  source: /note="Description of Artificial Sequence: Synthetic oligonucleotide"
auccugaugugcacgaaca

SEQ ID NO: 5987 - RNA, 19 nt, Artificial Sequence
  source: /note="Description of Artificial Sequence: Synthetic oligonucleotide"
uauccugaugugcacgaac

SEQ ID NO: 5988 - RNA, 19 nt, Artificial Sequence
  source: /note="Description of Artificial Sequence: Synthetic oligonucleotide"
auugcugcugugucccacc

SEQ ID NO: 5989 - RNA, 19 nt, Artificial Sequence
  source: /note="Description of Artificial Sequence: Synthetic oligonucleotide"
aauugcugcugugucccac

SEQ ID NO: 5990 - RNA, 19 nt, Artificial Sequence
  source: /note="Description of Artificial Sequence: Synthetic oligonucleotide"
aaauugcugcuguguccca

SEQ ID NO: 5991 - RNA, 19 nt, Artificial Sequence
  source: /note="Description of Artificial Sequence: Synthetic oligonucleotide"
uuucuuccaugcggacccc

SEQ ID NO: 5992 - RNA, 19 nt, Artificial Sequence
  source: /note="Description of Artificial Sequence: Synthetic oligonucleotide"
auuucuuccaugcggaccc

SEQ ID NO: 5993 - RNA, 19 nt, Artificial Sequence
  source: /note="Description of Artificial Sequence: Synthetic oligonucleotide"
aucccgagcuaggauguga

SEQ ID NO: 5994 - RNA, 19 nt, Artificial Sequence
  source: /note="Description of Artificial Sequence: Synthetic oligonucleotide"
aacaucccgagcuaggaug

SEQ ID NO: 5995 - RNA, 19 nt, Artificial Sequence
  source: /note="Description of Artificial Sequence: Synthetic oligonucleotide"
uugugaacaucccgagcua

SEQ ID NO: 5996 - RNA, 19 nt, Artificial Sequence
  source: /note="Description of Artificial Sequence: Synthetic oligonucleotide"
auucgguugugaacauccc

SEQ ID NO: 5997 - RNA, 19 nt, Artificial Sequence
  source: /note="Description of Artificial Sequence: Synthetic oligonucleotide"
aauucgguugugaacaucc

SEQ ID NO: 5998 - RNA, 19 nt, Artificial Sequence
  source: /note="Description of Artificial Sequence: Synthetic oligonucleotide"
aaugguauuuaguccucug

SEQ ID NO: 5999 - RNA, 19 nt, Artificial Sequence
  source: /note="Description of Artificial Sequence: Synthetic oligonucleotide"
auggaaugguauuuagucc

SEQ ID NO: 6000 - RNA, 19 nt, Artificial Sequence
  source: /note="Description of Artificial Sequence: Synthetic oligonucleotide"
aacaauggaaugguauuua

SEQ ID NO: 6001 - RNA, 19 nt, Artificial Sequence
  source: /note="Description of Artificial Sequence: Synthetic oligonucleotide"
aaacaauggaaugguauuu

SEQ ID NO: 6002 - RNA, 19 nt, Artificial Sequence
  source: /note="Description of Artificial Sequence: Synthetic oligonucleotide"
aagcagcugcacaaacaau

SEQ ID NO: 6003 - RNA, 19 nt, Artificial Sequence
  source: /note="Description of Artificial Sequence: Synthetic oligonucleotide"
aaagcagcugcacaaacaa

SEQ ID NO: 6004 - RNA, 19 nt, Artificial Sequence
  source: /note="Description of Artificial Sequence: Synthetic oligonucleotide"
uaaagcagcugcacaaaca

SEQ ID NO: 6005 - RNA, 19 nt, Artificial Sequence
  source: /note="Description of Artificial Sequence: Synthetic oligonucleotide"
auaaagcagcugcacaaac

SEQ ID NO: 6006 - RNA, 19 nt, Artificial Sequence
  source: /note="Description of Artificial Sequence: Synthetic oligonucleotide"
aauaaagcagcugcacaaa

SEQ ID NO: 6007 - RNA, 19 nt, Artificial Sequence
  source: /note="Description of Artificial Sequence: Synthetic oligonucleotide"
augggagaauaaagcagcu

SEQ ID NO: 6008 - RNA, 19 nt, Artificial Sequence
  source: /note="Description of Artificial Sequence: Synthetic oligonucleotide"
aaugggagaauaaagcagc

SEQ ID NO: 6009 - RNA, 19 nt, Artificial Sequence
  source: /note="Description of Artificial Sequence: Synthetic oligonucleotide"
uuuucaaugggagaauaaa

SEQ ID NO: 6010 - RNA, 19 nt, Artificial Sequence
  source: /note="Description of Artificial Sequence: Synthetic oligonucleotide"
auguuuucaaugggagaau

SEQ ID NO: 6011 - RNA, 19 nt, Artificial Sequence
  source: /note="Description of Artificial Sequence: Synthetic oligonucleotide"
uuggauguuuucaauggga

SEQ ID NO: 6012 - RNA, 19 nt, Artificial Sequence
  source: /note="Description of Artificial Sequence: Synthetic oligonucleotide"
uucacagaggaccccugca

SEQ ID NO: 6013 - RNA, 19 nt, Artificial Sequence
  source: /note="Description of Artificial Sequence: Synthetic oligonucleotide"
uuccuuguccugagcaagu

SEQ ID NO: 6014 - RNA, 19 nt, Artificial Sequence
  source: /note="Description of Artificial Sequence: Synthetic oligonucleotide"
aacucugucagaggagcug

SEQ ID NO: 6015 - RNA, 19 nt, Artificial Sequence
  source: /note="Description of Artificial Sequence: Synthetic oligonucleotide"
uaacucugucagaggagcu

SEQ ID NO: 6016 - RNA, 19 nt, Artificial Sequence
  source: /note="Description of Artificial Sequence: Synthetic oligonucleotide"
aaguaacucugucagagga

SEQ ID NO: 6017 - RNA, 19 nt, Artificial Sequence
  source: /note="Description of Artificial Sequence: Synthetic oligonucleotide"
uagagugaaguaacucugu

SEQ ID NO: 6018 - RNA, 19 nt, Artificial Sequence
  source: /note="Description of Artificial Sequence: Synthetic oligonucleotide"
uuccuagagugaaguaacu

SEQ ID NO: 6019 - RNA, 19 nt, Artificial Sequence
  source: /note="Description of Artificial Sequence: Synthetic oligonucleotide"
auuccuagagugaaguaac

SEQ ID NO: 6020 - RNA, 19 nt, Artificial Sequence
  source: /note="Description of Artificial Sequence: Synthetic oligonucleotide"
uucauuccuagagugaagu

SEQ ID NO: 6021 - RNA, 19 nt, Artificial Sequence
  source: /note="Description of Artificial Sequence: Synthetic oligonucleotide"
uucggaacaaaacagcagc

SEQ ID NO: 6022 - RNA, 19 nt, Artificial Sequence
  source: /note="Description of Artificial Sequence: Synthetic oligonucleotide"
auucggaacaaaacagcag

SEQ ID NO: 6023 - RNA, 19 nt, Artificial Sequence
  source: /note="Description of Artificial Sequence: Synthetic oligonucleotide"
uuguggcuuguccucagac

SEQ ID NO: 6024 - RNA, 19 nt, Artificial Sequence
  source: /note="Description of Artificial Sequence: Synthetic oligonucleotide"
aucuuguggcuuguccuca

SEQ ID NO: 6025 - RNA, 19 nt, Artificial Sequence
  source: /note="Description of Artificial Sequence: Synthetic oligonucleotide"
uuguaaucuuguggcuugu

SEQ ID NO: 6026 - RNA, 19 nt, Artificial Sequence
  source: /note="Description of Artificial Sequence: Synthetic oligonucleotide"
uucuuguaaucuuguggcu

SEQ ID NO: 6027 - RNA, 19 nt, Artificial Sequence
  source: /note="Description of Artificial Sequence: Synthetic oligonucleotide"
aagccguuucuuguaaucu

SEQ ID NO: 6028 - RNA, 19 nt, Artificial Sequence
  source: /note="Description of Artificial Sequence: Synthetic oligonucleotide"
aacugaaagccguuucuug

SEQ ID NO: 6029 - RNA, 19 nt, Artificial Sequence
  source: /note="Description of Artificial Sequence: Synthetic oligonucleotide"
aagagagagcuggucagcu

SEQ ID NO: 6030 - RNA, 19 nt, Artificial Sequence
  source: /note="Description of Artificial Sequence: Synthetic oligonucleotide"
uucugaagagagagcuggu

SEQ ID NO: 6031 - RNA, 19 nt, Artificial Sequence
  source: /note="Description of Artificial Sequence: Synthetic oligonucleotide"
uucucccugggcaccaaua

SEQ ID NO: 6032 - RNA, 19 nt, Artificial Sequence
  source: /note="Description of Artificial Sequence: Synthetic oligonucleotide"
auccaagggguucucccug

SEQ ID NO: 6033 - RNA, 19 nt, Artificial Sequence
  source: /note="Description of Artificial Sequence: Synthetic oligonucleotide"
uauccaagggguucucccu

SEQ ID NO: 6034 - RNA, 19 nt, Artificial Sequence
  source: /note="Description of Artificial Sequence: Synthetic oligonucleotide"
auccuggcgauauccaagg

SEQ ID NO: 6035 - RNA, 19 nt, Artificial Sequence
  source: /note="Description of Artificial Sequence: Synthetic oligonucleotide"
uaggaucauccuggcgaua

SEQ ID NO: 6036 - RNA, 19 nt, Artificial Sequence
  source: /note="Description of Artificial Sequence: Synthetic oligonucleotide"
uagcuaggaucauccuggc

SEQ ID NO: 6037 - RNA, 19 nt, Artificial Sequence
  source: /note="Description of Artificial Sequence: Synthetic oligonucleotide"
auagcuaggaucauccugg

SEQ ID NO: 6038 - RNA, 19 nt, Artificial Sequence
  source: /note="Description of Artificial Sequence: Synthetic oligonucleotide"
aacgauagcuaggaucauc

SEQ ID NO: 6039 - RNA, 19 nt, Artificial Sequence
  source: /note="Description of Artificial Sequence: Synthetic oligonucleotide"
aaagaacgauagcuaggau

SEQ ID NO: 6040 - RNA, 19 nt, Artificial Sequence
  source: /note="Description of Artificial Sequence: Synthetic oligonucleotide"
aaaagaacgauagcuagga

SEQ ID NO: 6041 - RNA, 19 nt, Artificial Sequence
  source: /note="Description of Artificial Sequence: Synthetic oligonucleotide"
auccaccagagugaaaaga

SEQ ID NO: 6042 - RNA, 19 nt, Artificial Sequence
  source: /note="Description of Artificial Sequence: Synthetic oligonucleotide"
uauccaccagagugaaaag

SEQ ID NO: 6043 - RNA, 19 nt, Artificial Sequence
  source: /note="Description of Artificial Sequence: Synthetic oligonucleotide"
auauccaccagagugaaaa

SEQ ID NO: 6044 - RNA, 19 nt, Artificial Sequence
  source: /note="Description of Artificial Sequence: Synthetic oligonucleotide"
auccuggccauauccacca

SEQ ID NO: 6045 - RNA, 19 nt, Artificial Sequence
  source: /note="Description of Artificial Sequence: Synthetic oligonucleotide"
aaggcauccuggccauauc

SEQ ID NO: 6046 - RNA, 19 nt, Artificial Sequence
  source: /note="Description of Artificial Sequence: Synthetic oligonucleotide"
augggguccauacccaagg

SEQ ID NO: 6047 - RNA, 19 nt, Artificial Sequence
  source: /note="Description of Artificial Sequence: Synthetic oligonucleotide"
aucaugggguccauaccca

SEQ ID NO: 6048 - RNA, 19 nt, Artificial Sequence
  source: /note="Description of Artificial Sequence: Synthetic oligonucleotide"
uaguuaaucaaguuuacaa

SEQ ID NO: 6049 - RNA, 19 nt, Artificial Sequence
  source: /note="Description of Artificial Sequence: Synthetic oligonucleotide"
auaguuaaucaaguuuaca

SEQ ID NO: 6050 - RNA, 19 nt, Artificial Sequence
  source: /note="Description of Artificial Sequence: Synthetic oligonucleotide"
uugauaguuaaucaaguuu

SEQ ID NO: 6051 - RNA, 19 nt, Artificial Sequence
  source: /note="Description of Artificial Sequence: Synthetic oligonucleotide"
uuccaucaugggguccaua

SEQ ID NO: 6052 - RNA, 19 nt, Artificial Sequence
  source: /note="Description of Artificial Sequence: Synthetic oligonucleotide"
auguuccaucauggggucc

SEQ ID NO: 6053 - RNA, 19 nt, Artificial Sequence
  source: /note="Description of Artificial Sequence: Synthetic oligonucleotide"
aucucauguuccaucaugg

SEQ ID NO: 6054 - RNA, 19 nt, Artificial Sequence
  source: /note="Description of Artificial Sequence: Synthetic oligonucleotide"
uagucagcaccaggguggu

SEQ ID NO: 6055 - RNA, 19 nt, Artificial Sequence
  source: /note="Description of Artificial Sequence: Synthetic oligonucleotide"
auagucagcaccagggugg

SEQ ID NO: 6056 - RNA, 19 nt, Artificial Sequence
  source: /note="Description of Artificial Sequence: Synthetic oligonucleotide"
aucaacuggauagucagca

SEQ ID NO: 6057 - RNA, 19 nt, Artificial Sequence
  source: /note="Description of Artificial Sequence: Synthetic oligonucleotide"
aucuggcagcccaucaacu

SEQ ID NO: 6058 - RNA, 19 nt, Artificial Sequence
  source: /note="Description of Artificial Sequence: Synthetic oligonucleotide"
auccaugagguccugggca

SEQ ID NO: 6059 - RNA, 19 nt, Artificial Sequence
  source: /note="Description of Artificial Sequence: Synthetic oligonucleotide"
aaccaggccagcugauugc

SEQ ID NO: 6060 - RNA, 19 nt, Artificial Sequence
  source: /note="Description of Artificial Sequence: Synthetic oligonucleotide"
aaaccaggccagcugauug

SEQ ID NO: 6061 - RNA, 19 nt, Artificial Sequence
  source: /note="Description of Artificial Sequence: Synthetic oligonucleotide"
uacaggucaguaucaaacc

SEQ ID NO: 6062 - RNA, 19 nt, Artificial Sequence
  source: /note="Description of Artificial Sequence: Synthetic oligonucleotide"
augauuuacaggucaguau

SEQ ID NO: 6063 - RNA, 19 nt, Artificial Sequence
  source: /note="Description of Artificial Sequence: Synthetic oligonucleotide"
aaggaugauuuacagguca

SEQ ID NO: 6064 - RNA, 19 nt, Artificial Sequence
  source: /note="Description of Artificial Sequence: Synthetic oligonucleotide"
aaaggaugauuuacagguc

SEQ ID NO: 6065 - RNA, 19 nt, Artificial Sequence
  source: /note="Description of Artificial Sequence: Synthetic oligonucleotide"
uaaaggaugauuuacaggu

SEQ ID NO: 6066 - RNA, 19 nt, Artificial Sequence
  source: /note="Description of Artificial Sequence: Synthetic oligonucleotide"
uuucuacaucauuuguauu

SEQ ID NO: 6067 - RNA, 19 nt, Artificial Sequence
  source: /note="Description of Artificial Sequence: Synthetic oligonucleotide"
auuacagauauucuuaaaa

SEQ ID NO: 6068 - RNA, 19 nt, Artificial Sequence
  source: /note="Description of Artificial Sequence: Synthetic oligonucleotide"
aaaauuagaaauugcugua

SEQ ID NO: 6069 - RNA, 19 nt, Artificial Sequence
  source: /note="Description of Artificial Sequence: Synthetic oligonucleotide"
gagugauuaugaauuagug

SEQ ID NO: 6070 - RNA, 19 nt, Artificial Sequence
  source: /note="Description of Artificial Sequence: Synthetic oligonucleotide"
agagugauuaugaauuagu

SEQ ID NO: 6071 - RNA, 19 nt, Artificial Sequence
  source: /note="Description of Artificial Sequence: Synthetic oligonucleotide"
uuagagugauuaugaauua

SEQ ID NO: 6072 - RNA, 19 nt, Artificial Sequence
  source: /note="Description of Artificial Sequence: Synthetic oligonucleotide"
auuagagugauuaugaauu

SEQ ID NO: 6073 - RNA, 19 nt, Artificial Sequence
  source: /note="Description of Artificial Sequence: Synthetic oligonucleotide"
cuuuauucagauuacaauu

SEQ ID NO: 6074 - RNA, 19 nt, Artificial Sequence
  source: /note="Description of Artificial Sequence: Synthetic oligonucleotide"
uuugucuauuuuauacaaa

SEQ ID NO: 6075 - RNA, 19 nt, Artificial Sequence
  source: /note="Description of Artificial Sequence: Synthetic oligonucleotide"
auuugucuauuuuauacaa

SEQ ID NO: 6076 - RNA, 19 nt, Artificial Sequence
  source: /note="Description of Artificial Sequence: Synthetic oligonucleotide"
uauuugucuauuuuauaca

SEQ ID NO: 6077 - RNA, 19 nt, Artificial Sequence
  source: /note="Description of Artificial Sequence: Synthetic oligonucleotide"
cuauuugucuauuuuauac

SEQ ID NO: 6078 - RNA, 19 nt, Artificial Sequence
  source: /note="Description of Artificial Sequence: Synthetic oligonucleotide"
uucuauuugucuauuuuau

SEQ ID NO: 6079 - RNA, 19 nt, Artificial Sequence
  source: /note="Description of Artificial Sequence: Synthetic oligonucleotide"
uuucuauuugucuauuuua

SEQ ID NO: 6080 - RNA, 19 nt, Artificial Sequence
  source: /note="Description of Artificial Sequence: Synthetic oligonucleotide"
auuuucuauuugucuauuu

SEQ ID NO: 6081 - RNA, 19 nt, Artificial Sequence
  source: /note="Description of Artificial Sequence: Synthetic oligonucleotide"
ccuacccauacauauccca

SEQ ID NO: 6082 - RNA, 19 nt, Artificial Sequence
  source: /note="Description of Artificial Sequence: Synthetic oligonucleotide"
cccuacccauacauauccc

SEQ ID NO: 6083 - RNA, 19 nt, Artificial Sequence
  source: /note="Description of Artificial Sequence: Synthetic oligonucleotide"
uagagugauuaugaauuag

SEQ ID NO: 6084 - RNA, 19 nt, Artificial Sequence
  source: /note="Description of Artificial Sequence: Synthetic oligonucleotide"
auuggaccauuuucuauuu

SEQ ID NO: 6085 - RNA, 19 nt, Artificial Sequence
  source: /note="Description of Artificial Sequence: Synthetic oligonucleotide"
aauuggaccauuuucuauu

SEQ ID NO: 6086 - RNA, 19 nt, Artificial Sequence
  source: /note="Description of Artificial Sequence: Synthetic oligonucleotide"
aacugguaaacuguccaaa

SEQ ID NO: 6087 - RNA, 19 nt, Artificial Sequence
  source: /note="Description of Artificial Sequence: Synthetic oligonucleotide"
aagugagguuagaaagaau

SEQ ID NO: 6088 - RNA, 19 nt, Artificial Sequence
  source: /note="Description of Artificial Sequence: Synthetic oligonucleotide"
aagauuucgaaucaaucca

SEQ ID NO: 6089 - RNA, 19 nt, Artificial Sequence
  source: /note="Description of Artificial Sequence: Synthetic oligonucleotide"
uggugcugacuauccaguu

SEQ ID NO: 6090 - RNA, 19 nt, Artificial Sequence
  source: /note="Description of Artificial Sequence: Synthetic oligonucleotide"
gaccccaagcuuuaguaaa

SEQ ID NO: 6091 - RNA, 19 nt, Artificial Sequence
  source: /note="Description of Artificial Sequence: Synthetic oligonucleotide"
ccaagcuuuaguaaauaua

SEQ ID NO: 6092 - RNA, 19 nt, Artificial Sequence
  source: /note="Description of Artificial Sequence: Synthetic oligonucleotide"
caagcuuuaguaaauauaa

SEQ ID NO: 6093 - RNA, 19 nt, Artificial Sequence
  source: /note="Description of Artificial Sequence: Synthetic oligonucleotide"
uucagaugcugcaacuaaa

SEQ ID NO: 6094 - RNA, 19 nt, Artificial Sequence
  source: /note="Description of Artificial Sequence: Synthetic oligonucleotide"
cagcuggaauucuuucuaa

SEQ ID NO: 6095 - RNA, 19 nt, Artificial Sequence
  source: /note="Description of Artificial Sequence: Synthetic oligonucleotide"
gacuaccaguugugguuaa

SEQ ID NO: 6096 - RNA, 19 nt, Artificial Sequence
  source: /note="Description of Artificial Sequence: Synthetic oligonucleotide"
acuguuggauugauucgaa

SEQ ID NO: 6097 - RNA, 19 nt, Artificial Sequence
  source: /note="Description of Artificial Sequence: Synthetic oligonucleotide"
uguuggauugauucgaaau

SEQ ID NO: 6098 - RNA, 19 nt, Artificial Sequence
  source: /note="Description of Artificial Sequence: Synthetic oligonucleotide"
ggguccgcauggaagaaau

SEQ ID NO: 6099 - RNA, 19 nt, Artificial Sequence
  source: /note="Description of Artificial Sequence: Synthetic oligonucleotide"
cucugacagaguuacuuca

SEQ ID NO: 6100 - RNA, 19 nt, Artificial Sequence
  source: /note="Description of Artificial Sequence: Synthetic oligonucleotide"
uccuagcuaucguucuuuu

SEQ ID NO: 6101 - RNA, 19 nt, Artificial Sequence
  source: /note="Description of Artificial Sequence: Synthetic oligonucleotide"
ccauacaacuguuuugaaa

SEQ ID NO: 6102 - RNA, 19 nt, Artificial Sequence
  source: /note="Description of Artificial Sequence: Synthetic oligonucleotide"
aagugaagaaugcacaaga

SEQ ID NO: 6103 - RNA, 19 nt, Artificial Sequence
  source: /note="Description of Artificial Sequence: Synthetic oligonucleotide"
aucacaagauggaauuuau

SEQ ID NO: 6104 - RNA, 19 nt, Artificial Sequence
  source: /note="Description of Artificial Sequence: Synthetic oligonucleotide"
agccuugcuuguuaaauuu

SEQ ID NO: 6105 - RNA, 19 nt, Artificial Sequence
  source: /note="Description of Artificial Sequence: Synthetic oligonucleotide"
aauagaaaaugguccaauu

SEQ ID NO: 6106 - RNA, 19 nt, Artificial Sequence
  source: /note="Description of Artificial Sequence: Synthetic oligonucleotide"
gauuaacuaucaagaugau

SEQ ID NO: 6107 - RNA, 19 nt, Artificial Sequence
  source: /note="Description of Artificial Sequence: Synthetic oligonucleotide"
cuaucaagaugaugcagaa

SEQ ID NO: 6108 - RNA, 19 nt, Artificial Sequence
  source: /note="Description of Artificial Sequence: Synthetic oligonucleotide"
gauggugucugcuauugua

SEQ ID NO: 6109 - RNA, 19 nt, Artificial Sequence
  source: /note="Description of Artificial Sequence: Synthetic oligonucleotide"
caugcagaauacaaaugau

SEQ ID NO: 6110 - RNA, 19 nt, Artificial Sequence
  source: /note="Description of Artificial Sequence: Synthetic oligonucleotide"
gaauacaaaugauguagaa

SEQ ID NO: 6111 - RNA, 19 nt, Artificial Sequence
  source: /note="Description of Artificial Sequence: Synthetic oligonucleotide"
uuuacuaaagcuugggguc

SEQ ID NO: 6112 - RNA, 19 nt, Artificial Sequence
  source: /note="Description of Artificial Sequence: Synthetic oligonucleotide"
uauauuuacuaaagcuugg

SEQ ID NO: 6113 - RNA, 19 nt, Artificial Sequence
  source: /note="Description of Artificial Sequence: Synthetic oligonucleotide"
uuauauuuacuaaagcuug

SEQ ID NO: 6114 - RNA, 19 nt, Artificial Sequence
  source: /note="Description of Artificial Sequence: Synthetic oligonucleotide"
uuuaguugcagcaucugaa

SEQ ID NO: 6115 - RNA, 19 nt, Artificial Sequence
  source: /note="Description of Artificial Sequence: Synthetic oligonucleotide"
uuagaaagaauuccagcug

SEQ ID NO: 6116 - RNA, 19 nt, Artificial Sequence
  source: /note="Description of Artificial Sequence: Synthetic oligonucleotide"
uuaaccacaacugguaguc

SEQ ID NO: 6117 - RNA, 19 nt, Artificial Sequence
  source: /note="Description of Artificial Sequence: Synthetic oligonucleotide"
uucgaaucaauccaacagu

SEQ ID NO: 6118 - RNA, 19 nt, Artificial Sequence
  source: /note="Description of Artificial Sequence: Synthetic oligonucleotide"
auuucgaaucaauccaaca

SEQ ID NO: 6119 - RNA, 19 nt, Artificial Sequence
  source: /note="Description of Artificial Sequence: Synthetic oligonucleotide"
auuucuuccaugcggaccc

SEQ ID NO: 6120 - RNA, 19 nt, Artificial Sequence
  source: /note="Description of Artificial Sequence: Synthetic oligonucleotide"
ugaaguaacucugucagag

SEQ ID NO: 6121 - RNA, 19 nt, Artificial Sequence
  source: /note="Description of Artificial Sequence: Synthetic oligonucleotide"
aaaagaacgauagcuagga

SEQ ID NO: 6122 - RNA, 19 nt, Artificial Sequence
  source: /note="Description of Artificial Sequence: Synthetic oligonucleotide"
uuucaaaacaguuguaugg

SEQ ID NO: 6123 - RNA, 19 nt, Artificial Sequence
  source: /note="Description of Artificial Sequence: Synthetic oligonucleotide"
ucuugugcauucuucacuu

SEQ ID NO: 6124 - RNA, 19 nt, Artificial Sequence
  source: /note="Description of Artificial Sequence: Synthetic oligonucleotide"
auaaauuccaucuugugau

SEQ ID NO: 6125 - RNA, 19 nt, Artificial Sequence
  source: /note="Description of Artificial Sequence: Synthetic oligonucleotide"
aaauuuaacaagcaaggcu

SEQ ID NO: 6126 - RNA, 19 nt, Artificial Sequence
  source: /note="Description of Artificial Sequence: Synthetic oligonucleotide"
aauuggaccauuuucuauu

SEQ ID NO: 6127 - RNA, 19 nt, Artificial Sequence
  source: /note="Description of Artificial Sequence: Synthetic oligonucleotide"
aucaucuugauaguuaauc

SEQ ID NO: 6128 - RNA, 19 nt, Artificial Sequence
  source: /note="Description of Artificial Sequence: Synthetic oligonucleotide"
uucugcaucaucuugauag

SEQ ID NO: 6129 - RNA, 19 nt, Artificial Sequence
  source: /note="Description of Artificial Sequence: Synthetic oligonucleotide"
uacaauagcagacaccauc

SEQ ID NO: 6130 - RNA, 19 nt, Artificial Sequence
  source: /note="Description of Artificial Sequence: Synthetic oligonucleotide"
aucauuuguauucugcaug

SEQ ID NO: 6131 - RNA, 19 nt, Artificial Sequence
  source: /note="Description of Artificial Sequence: Synthetic oligonucleotide"
uucuacaucauuuguauuc

SEQ ID NO: 6132 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugcugacuauccaguutt

SEQ ID NO: 6133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugcugacuauccaguutt

SEQ ID NO: 6134 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuggauagucagcaccatt

SEQ ID NO: 6135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuggauagucagcaccatt

SEQ ID NO: 6136 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugcugacuauccaguutt

SEQ ID NO: 6137 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggugcugacuauccaguutt

SEQ ID NO: 6138 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuggauagucagcaccatt

SEQ ID NO: 6139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacuggauagucagcaccatt

SEQ ID NO: 6140 - RNA, 19 nt, Artificial Sequence
  source: /note="Description of Artificial Sequence: Synthetic oligonucleotide"
uggugcugacuauccaguu

SEQ ID NO: 6141 - DNA, 19 bp, Artificial Sequence
  source: /note="Description of Artificial Sequence: Synthetic oligonucleotide"
ccatacaactgttttgaaa

SEQ ID NO: 6142 - DNA, 19 bp, Artificial Sequence
  source: /note="Description of Artificial Sequence: Synthetic oligonucleotide"
gattaactatcaagatgat

SEQ ID NO: 6143 - DNA, 19 bp, Artificial Sequence
  source: /note="Description of Artificial Sequence: Synthetic oligonucleotide"
ctatcaagatgatgcagaa

SEQ ID NO: 6144 - DNA, 19 bp, Artificial Sequence
  source: /note="Description of Artificial Sequence: Synthetic oligonucleotide"
gaatacaaatgatgtagaa

SEQ ID NO: 6145 - DNA, 19 bp, Artificial Sequence
  source: /note="Description of Artificial Sequence: Synthetic oligonucleotide"
tgttggattgattcgaaat

SEQ ID NO: 6146 - DNA, 19 bp, Artificial Sequence
  source: /note="Description of Artificial Sequence: Synthetic oligonucleotide"
gggtccgcatggaagaaat

SEQ ID NO: 6147 - DNA, 19 bp, Artificial Sequence
  source: /note="Description of Artificial Sequence: Synthetic oligonucleotide"
tcctagctatcgttctttt

SEQ ID NO: 6148 - DNA, 19 bp, Artificial Sequence
  source: /note="Description of Artificial Sequence: Synthetic oligonucleotide"
aagtgaagaatgcacaaga

SEQ ID NO: 6149 - DNA, 19 bp, Artificial Sequence
  source: /note="Description of Artificial Sequence: Synthetic oligonucleotide"
catgcagaatacaaatgat

SEQ ID NO: 6150 - DNA, 19 bp, Artificial Sequence
  source: /note="Description of Artificial Sequence: Synthetic oligonucleotide"
actgttggattgattcgaa

SEQ ID NO: 6151 - DNA, 19 bp, Artificial Sequence
  source: /note="Description of Artificial Sequence: Synthetic oligonucleotide"
gaccccaagctttagtaaa

SEQ ID NO: 6152 - DNA, 19 bp, Artificial Sequence
  source: /note="Description of Artificial Sequence: Synthetic oligonucleotide"
agccttgcttgttaaattt

SEQ ID NO: 6153 - DNA, 19 bp, Artificial Sequence
  source: /note="Description of Artificial Sequence: Synthetic oligonucleotide"
ttcagatgctgcaactaaa

SEQ ID NO: 6154 - DNA, 19 bp, Artificial Sequence
  source: /note="Description of Artificial Sequence: Synthetic oligonucleotide"
atcacaagatggaatttat

SEQ ID NO: 6155 - DNA, 19 bp, Artificial Sequence
  source: /note="Description of Artificial Sequence: Synthetic oligonucleotide"
aatagaaaatggtccaatt

SEQ ID NO: 6156 - DNA, 19 bp, Artificial Sequence
  source: /note="Description of Artificial Sequence: Synthetic oligonucleotide"
gatggtgtctgctattgta

SEQ ID NO: 6157 - DNA, 19 bp, Artificial Sequence
  source: /note="Description of Artificial Sequence: Synthetic oligonucleotide"
ccaagctttagtaaatata

SEQ ID NO: 6158 - DNA, 19 bp, Artificial Sequence
  source: /note="Description of Artificial Sequence: Synthetic oligonucleotide"
caagctttagtaaatataa

SEQ ID NO: 6159 - DNA, 19 bp, Artificial Sequence
  source: /note="Description of Artificial Sequence: Synthetic oligonucleotide"
ctctgacagagttacttca

SEQ ID NO: 6160 - DNA, 19 bp, Artificial Sequence
  source: /note="Description of Artificial Sequence: Synthetic oligonucleotide"
cagctggaattctttctaa

SEQ ID NO: 6161 - DNA, 19 bp, Artificial Sequence
  source: /note="Description of Artificial Sequence: Synthetic oligonucleotide"
gactaccagttgtggttaa

SEQ ID NO: 6162 - DNA, 19 bp, Artificial Sequence
  source: /note="Description of Artificial Sequence: Synthetic oligonucleotide"
ccatacaactgttttgaaa

SEQ ID NO: 6163 - DNA, 19 bp, Artificial Sequence
  source: /note="Description of Artificial Sequence: Synthetic oligonucleotide"
gattaactatcaagatgat

SEQ ID NO: 6164 - DNA, 19 bp, Artificial Sequence
  source: /note="Description of Artificial Sequence: Synthetic oligonucleotide"
ctatcaagatgatgcagaa

SEQ ID NO: 6165 - DNA, 19 bp, Artificial Sequence
  source: /note="Description of Artificial Sequence: Synthetic oligonucleotide"
gaatacaaatgatgtagaa

SEQ ID NO: 6166 - DNA, 19 bp, Artificial Sequence
  source: /note="Description of Artificial Sequence: Synthetic oligonucleotide"
tgttggattgattcgaaat

SEQ ID NO: 6167 - DNA, 19 bp, Artificial Sequence
  source: /note="Description of Artificial Sequence: Synthetic oligonucleotide"
gggtccgcatggaagaaat

SEQ ID NO: 6168 - DNA, 19 bp, Artificial Sequence
  source: /note="Description of Artificial Sequence: Synthetic oligonucleotide"
tcctagctatcgttctttt

SEQ ID NO: 6169 - DNA, 19 bp, Artificial Sequence
  source: /note="Description of Artificial Sequence: Synthetic oligonucleotide"
aagtgaagaatgcacaaga

SEQ ID NO: 6170 - DNA, 19 bp, Artificial Sequence
  source: /note="Description of Artificial Sequence: Synthetic oligonucleotide"
catgcagaatacaaatgat

SEQ ID NO: 6171 - DNA, 19 bp, Artificial Sequence
  source: /note="Description of Artificial Sequence: Synthetic oligonucleotide"
actgttggattgattcgaa

SEQ ID NO: 6172 - DNA, 19 bp, Artificial Sequence
  source: /note="Description of Artificial Sequence: Synthetic oligonucleotide"
gaccccaagctttagtaaa

SEQ ID NO: 6173 - DNA, 19 bp, Artificial Sequence
  source: /note="Description of Artificial Sequence: Synthetic oligonucleotide"
agccttgcttgttaaattt

SEQ ID NO: 6174 - DNA, 19 bp, Artificial Sequence
  source: /note="Description of Artificial Sequence: Synthetic oligonucleotide"
ttcagatgctgcaactaaa

SEQ ID NO: 6175 - DNA, 19 bp, Artificial Sequence
  source: /note="Description of Artificial Sequence: Synthetic oligonucleotide"
atcacaagatggaatttat

SEQ ID NO: 6176 - DNA, 19 bp, Artificial Sequence
  source: /note="Description of Artificial Sequence: Synthetic oligonucleotide"
aatagaaaatggtccaatt

SEQ ID NO: 6177 - DNA, 19 bp, Artificial Sequence
  source: /note="Description of Artificial Sequence: Synthetic oligonucleotide"
gatggtgtctgctattgta

SEQ ID NO: 6178 - DNA, 19 bp, Artificial Sequence
  source: /note="Description of Artificial Sequence: Synthetic oligonucleotide"
ccaagctttagtaaatata

SEQ ID NO: 6179 - DNA, 19 bp, Artificial Sequence
  source: /note="Description of Artificial Sequence: Synthetic oligonucleotide"
caagctttagtaaatataa

SEQ ID NO: 6180 - DNA, 19 bp, Artificial Sequence
  source: /note="Description of Artificial Sequence: Synthetic oligonucleotide"
ctctgacagagttacttca

SEQ ID NO: 6181 - DNA, 19 bp, Artificial Sequence
  source: /note="Description of Artificial Sequence: Synthetic oligonucleotide"
cagctggaattctttctaa

SEQ ID NO: 6182 - DNA, 19 bp, Artificial Sequence
  source: /note="Description of Artificial Sequence: Synthetic oligonucleotide"
gactaccagttgtggttaa

SEQ ID NO: 6183 - DNA, 19 bp, Artificial Sequence
  source: /note="Description of Artificial Sequence: Synthetic oligonucleotide"
ccatacaactgttttgaaa

SEQ ID NO: 6184 - DNA, 19 bp, Artificial Sequence
  source: /note="Description of Artificial Sequence: Synthetic oligonucleotide"
gattaactatcaagatgat

SEQ ID NO: 6185 - DNA, 19 bp, Artificial Sequence
  source: /note="Description of Artificial Sequence: Synthetic oligonucleotide"
ctatcaagatgatgcagaa

SEQ ID NO: 6186 - DNA, 19 bp, Artificial Sequence
  source: /note="Description of Artificial Sequence: Synthetic oligonucleotide"
gaatacaaatgatgtagaa

SEQ ID NO: 6187 - DNA, 19 bp, Artificial Sequence
  source: /note="Description of Artificial Sequence: Synthetic oligonucleotide"
tgttggattgattcgaaat

SEQ ID NO: 6188 - DNA, 19 bp, Artificial Sequence
  source: /note="Description of Artificial Sequence: Synthetic oligonucleotide"
gggtccgcatggaagaaat

SEQ ID NO: 6189 - DNA, 19 bp, Artificial Sequence
  source: /note="Description of Artificial Sequence: Synthetic oligonucleotide"
tcctagctatcgttctttt

SEQ ID NO: 6190 - DNA, 19 bp, Artificial Sequence
  source: /note="Description of Artificial Sequence: Synthetic oligonucleotide"
aagtgaagaatgcacaaga

SEQ ID NO: 6191 - DNA, 19 bp, Artificial Sequence
  source: /note="Description of Artificial Sequence: Synthetic oligonucleotide"
catgcagaatacaaatgat

SEQ ID NO: 6192 - DNA, 19 bp, Artificial Sequence
  source: /note="Description of Artificial Sequence: Synthetic oligonucleotide"
actgttggattgattcgaa

SEQ ID NO: 6193 - DNA, 19 bp, Artificial Sequence
  source: /note="Description of Artificial Sequence: Synthetic oligonucleotide"
gaccccaagctttagtaaa

SEQ ID NO: 6194 - DNA, 19 bp, Artificial Sequence
  source: /note="Description of Artificial Sequence: Synthetic oligonucleotide"
agccttgcttgttaaattt

SEQ ID NO: 6195 - DNA, 19 bp, Artificial Sequence
  source: /note="Description of Artificial Sequence: Synthetic oligonucleotide"
ttcagatgctgcaactaaa

SEQ ID NO: 6196 - DNA, 19 bp, Artificial Sequence
  source: /note="Description of Artificial Sequence: Synthetic oligonucleotide"
atcacaagatggaatttat

SEQ ID NO: 6197 - DNA, 19 bp, Artificial Sequence
  source: /note="Description of Artificial Sequence: Synthetic oligonucleotide"
aatagaaaatggtccaatt

SEQ ID NO: 6198 - DNA, 19 bp, Artificial Sequence
  source: /note="Description of Artificial Sequence: Synthetic oligonucleotide"
gatggtgtctgctattgta

SEQ ID NO: 6199 - DNA, 19 bp, Artificial Sequence
  source: /note="Description of Artificial Sequence: Synthetic oligonucleotide"
ccaagctttagtaaatata

SEQ ID NO: 6200 - DNA, 19 bp, Artificial Sequence
  source: /note="Description of Artificial Sequence: Synthetic oligonucleotide"
caagctttagtaaatataa

SEQ ID NO: 6201 - DNA, 19 bp, Artificial Sequence
  source: /note="Description of Artificial Sequence: Synthetic oligonucleotide"
ctctgacagagttacttca

SEQ ID NO: 6202 - DNA, 19 bp, Artificial Sequence
  source: /note="Description of Artificial Sequence: Synthetic oligonucleotide"
cagctggaattctttctaa

SEQ ID NO: 6203 - DNA, 19 bp, Artificial Sequence
  source: /note="Description of Artificial Sequence: Synthetic oligonucleotide"
gactaccagttgtggttaa

SEQ ID NO: 6204 - DNA, 19 bp, Artificial Sequence
  source: /note="Description of Artificial Sequence: Synthetic oligonucleotide"
ccatacaactgttttgaaa

SEQ ID NO: 6205 - DNA, 19 bp, Artificial Sequence
  source: /note="Description of Artificial Sequence: Synthetic oligonucleotide"
gattaactatcaagatgat

SEQ ID NO: 6206 - DNA, 19 bp, Artificial Sequence
  source: /note="Description of Artificial Sequence: Synthetic oligonucleotide"
ctatcaagatgatgcagaa

SEQ ID NO: 6207 - DNA, 19 bp, Artificial Sequence
  source: /note="Description of Artificial Sequence: Synthetic oligonucleotide"
gaatacaaatgatgtagaa

SEQ ID NO: 6208 - DNA, 19 bp, Artificial Sequence
  source: /note="Description of Artificial Sequence: Synthetic oligonucleotide"
tgttggattgattcgaaat

SEQ ID NO: 6209 - DNA, 19 bp, Artificial Sequence
  source: /note="Description of Artificial Sequence: Synthetic oligonucleotide"
gggtccgcatggaagaaat

SEQ ID NO: 6210 - DNA, 19 bp, Artificial Sequence
  source: /note="Description of Artificial Sequence: Synthetic oligonucleotide"
tcctagctatcgttctttt

SEQ ID NO: 6211 - DNA, 19 bp, Artificial Sequence
  source: /note="Description of Artificial Sequence: Synthetic oligonucleotide"
aagtgaagaatgcacaaga

SEQ ID NO: 6212 - DNA, 19 bp, Artificial Sequence
  source: /note="Description of Artificial Sequence: Synthetic oligonucleotide"
catgcagaatacaaatgat

SEQ ID NO: 6213 - DNA, 19 bp, Artificial Sequence
  source: /note="Description of Artificial Sequence: Synthetic oligonucleotide"
actgttggattgattcgaa

SEQ ID NO: 6214 - DNA, 19 bp, Artificial Sequence
  source: /note="Description of Artificial Sequence: Synthetic oligonucleotide"
gaccccaagctttagtaaa

SEQ ID NO: 6215 - DNA, 19 bp, Artificial Sequence
  source: /note="Description of Artificial Sequence: Synthetic oligonucleotide"
agccttgcttgttaaattt

SEQ ID NO: 6216 - DNA, 19 bp, Artificial Sequence
  source: /note="Description of Artificial Sequence: Synthetic oligonucleotide"
ttcagatgctgcaactaaa

SEQ ID NO: 6217 - DNA, 19 bp, Artificial Sequence
  source: /note="Description of Artificial Sequence: Synthetic oligonucleotide"
atcacaagatggaatttat

SEQ ID NO: 6218 - DNA, 19 bp, Artificial Sequence
  source: /note="Description of Artificial Sequence: Synthetic oligonucleotide"
aatagaaaatggtccaatt

SEQ ID NO: 6219 - DNA, 19 bp, Artificial Sequence
  source: /note="Description of Artificial Sequence: Synthetic oligonucleotide"
gatggtgtctgctattgta

SEQ ID NO: 6220 - DNA, 19 bp, Artificial Sequence
  source: /note="Description of Artificial Sequence: Synthetic oligonucleotide"
ccaagctttagtaaatata

SEQ ID NO: 6221 - DNA, 19 bp, Artificial Sequence
  source: /note="Description of Artificial Sequence: Synthetic oligonucleotide"
caagctttagtaaatataa

SEQ ID NO: 6222 - DNA, 19 bp, Artificial Sequence
  source: /note="Description of Artificial Sequence: Synthetic oligonucleotide"
ctctgacagagttacttca

SEQ ID NO: 6223 - DNA, 19 bp, Artificial Sequence
  source: /note="Description of Artificial Sequence: Synthetic oligonucleotide"
cagctggaattctttctaa

SEQ ID NO: 6224 - DNA, 19 bp, Artificial Sequence
  source: /note="Description of Artificial Sequence: Synthetic oligonucleotide"
gactaccagttgtggttaa

SEQ ID NO: 6225 - DNA, 19 bp, Artificial Sequence
  source: /note="Description of Artificial Sequence: Synthetic oligonucleotide"
ccatacaactgttttgaaa

SEQ ID NO: 6226 - DNA, 19 bp, Artificial Sequence
  source: /note="Description of Artificial Sequence: Synthetic oligonucleotide"
gattaactatcaagatgat

SEQ ID NO: 6227 - DNA, 19 bp, Artificial Sequence
  source: /note="Description of Artificial Sequence: Synthetic oligonucleotide"
ctatcaagatgatgcagaa

SEQ ID NO: 6228 - DNA, 19 bp, Artificial Sequence
  source: /note="Description of Artificial Sequence: Synthetic oligonucleotide"
gaatacaaatgatgtagaa

SEQ ID NO: 6229 - DNA, 19 bp, Artificial Sequence
  source: /note="Description of Artificial Sequence: Synthetic oligonucleotide"
tgttggattgattcgaaat

SEQ ID NO: 6230 - DNA, 19 bp, Artificial Sequence
  source: /note="Description of Artificial Sequence: Synthetic oligonucleotide"
gggtccgcatggaagaaat

SEQ ID NO: 6231 - DNA, 19 bp, Artificial Sequence
  source: /note="Description of Artificial Sequence: Synthetic oligonucleotide"
tcctagctatcgttctttt

SEQ ID NO: 6232 - DNA, 19 bp, Artificial Sequence
  source: /note="Description of Artificial Sequence: Synthetic oligonucleotide"
aagtgaagaatgcacaaga

SEQ ID NO: 6233 - DNA, 19 bp, Artificial Sequence
  source: /note="Description of Artificial Sequence: Synthetic oligonucleotide"
catgcagaatacaaatgat

SEQ ID NO: 6234 - DNA, 19 bp, Artificial Sequence
  source: /note="Description of Artificial Sequence: Synthetic oligonucleotide"
actgttggattgattcgaa

SEQ ID NO: 6235 - DNA, 19 bp, Artificial Sequence
  source: /note="Description of Artificial Sequence: Synthetic oligonucleotide"
gaccccaagctttagtaaa

SEQ ID NO: 6236 - DNA, 19 bp, Artificial Sequence
  source: /note="Description of Artificial Sequence: Synthetic oligonucleotide"
agccttgcttgttaaattt

SEQ ID NO: 6237 - DNA, 19 bp, Artificial Sequence
  source: /note="Description of Artificial Sequence: Synthetic oligonucleotide"
ttcagatgctgcaactaaa

SEQ ID NO: 6238 - DNA, 19 bp, Artificial Sequence
  source: /note="Description of Artificial Sequence: Synthetic oligonucleotide"
atcacaagatggaatttat

SEQ ID NO: 6239 - DNA, 19 bp, Artificial Sequence
  source: /note="Description of Artificial Sequence: Synthetic oligonucleotide"
aatagaaaatggtccaatt

SEQ ID NO: 6240 - DNA, 19 bp, Artificial Sequence
  source: /note="Description of Artificial Sequence: Synthetic oligonucleotide"
gatggtgtctgctattgta

SEQ ID NO: 6241 - DNA, 19 bp, Artificial Sequence
  source: /note="Description of Artificial Sequence: Synthetic oligonucleotide"
ccaagctttagtaaatata

SEQ ID NO: 6242 - DNA, 19 bp, Artificial Sequence
  source: /note="Description of Artificial Sequence: Synthetic oligonucleotide"
caagctttagtaaatataa

SEQ ID NO: 6243 - DNA, 19 bp, Artificial Sequence
  source: /note="Description of Artificial Sequence: Synthetic oligonucleotide"
ctctgacagagttacttca

SEQ ID NO: 6244 - DNA, 19 bp, Artificial Sequence
  source: /note="Description of Artificial Sequence: Synthetic oligonucleotide"
cagctggaattctttctaa

SEQ ID NO: 6245 - DNA, 19 bp, Artificial Sequence
  source: /note="Description of Artificial Sequence: Synthetic oligonucleotide"
gactaccagttgtggttaa

SEQ ID NO: 6246 - DNA, 19 bp, Artificial Sequence
  source: /note="Description of Artificial Sequence: Synthetic oligonucleotide"
ccatacaactgttttgaaa

SEQ ID NO: 6247 - DNA, 19 bp, Artificial Sequence
  source: /note="Description of Artificial Sequence: Synthetic oligonucleotide"
gattaactatcaagatgat

SEQ ID NO: 6248 - DNA, 19 bp, Artificial Sequence
  source: /note="Description of Artificial Sequence: Synthetic oligonucleotide"
ctatcaagatgatgcagaa

SEQ ID NO: 6249 - DNA, 19 bp, Artificial Sequence
  source: /note="Description of Artificial Sequence: Synthetic oligonucleotide"
gaatacaaatgatgtagaa

SEQ ID NO: 6250 - DNA, 19 bp, Artificial Sequence
  source: /note="Description of Artificial Sequence: Synthetic oligonucleotide"
tgttggattgattcgaaat

SEQ ID NO: 6251 - DNA, 19 bp, Artificial Sequence
  source: /note="Description of Artificial Sequence: Synthetic oligonucleotide"
gggtccgcatggaagaaat

SEQ ID NO: 6252 - DNA, 19 bp, Artificial Sequence
  source: /note="Description of Artificial Sequence: Synthetic oligonucleotide"
tcctagctatcgttctttt

SEQ ID NO: 6253 - DNA, 19 bp, Artificial Sequence
  source: /note="Description of Artificial Sequence: Synthetic oligonucleotide"
aagtgaagaatgcacaaga

SEQ ID NO: 6254 - DNA, 19 bp, Artificial Sequence
  source: /note="Description of Artificial Sequence: Synthetic oligonucleotide"
catgcagaatacaaatgat

SEQ ID NO: 6255 - DNA, 19 bp, Artificial Sequence
  source: /note="Description of Artificial Sequence: Synthetic oligonucleotide"
actgttggattgattcgaa

SEQ ID NO: 6256 - DNA, 19 bp, Artificial Sequence
  source: /note="Description of Artificial Sequence: Synthetic oligonucleotide"
gaccccaagctttagtaaa

SEQ ID NO: 6257 - DNA, 19 bp, Artificial Sequence
  source: /note="Description of Artificial Sequence: Synthetic oligonucleotide"
agccttgcttgttaaattt

SEQ ID NO: 6258 - DNA, 19 bp, Artificial Sequence
  source: /note="Description of Artificial Sequence: Synthetic oligonucleotide"
ttcagatgctgcaactaaa

SEQ ID NO: 6259 - DNA, 19 bp, Artificial Sequence
  source: /note="Description of Artificial Sequence: Synthetic oligonucleotide"
atcacaagatggaatttat

SEQ ID NO: 6260 - DNA, 19 bp, Artificial Sequence
  source: /note="Description of Artificial Sequence: Synthetic oligonucleotide"
aatagaaaatggtccaatt

SEQ ID NO: 6261 - DNA, 19 bp, Artificial Sequence
  source: /note="Description of Artificial Sequence: Synthetic oligonucleotide"
gatggtgtctgctattgta

SEQ ID NO: 6262 - DNA, 19 bp, Artificial Sequence
  source: /note="Description of Artificial Sequence: Synthetic oligonucleotide"
ccaagctttagtaaatata

SEQ ID NO: 6263 - DNA, 19 bp, Artificial Sequence
  source: /note="Description of Artificial Sequence: Synthetic oligonucleotide"
caagctttagtaaatataa

SEQ ID NO: 6264 - DNA, 19 bp, Artificial Sequence
  source: /note="Description of Artificial Sequence: Synthetic oligonucleotide"
ctctgacagagttacttca

SEQ ID NO: 6265 - DNA, 19 bp, Artificial Sequence
  source: /note="Description of Artificial Sequence: Synthetic oligonucleotide"
cagctggaattctttctaa

SEQ ID NO: 6266 - DNA, 19 bp, Artificial Sequence
  source: /note="Description of Artificial Sequence: Synthetic oligonucleotide"
gactaccagttgtggttaa

SEQ ID NO: 6267 - DNA, 19 bp, Artificial Sequence
  source: /note="Description of Artificial Sequence: Synthetic oligonucleotide"
ccatacaactgttttgaaa

SEQ ID NO: 6268 - DNA, 19 bp, Artificial Sequence
  source: /note="Description of Artificial Sequence: Synthetic oligonucleotide"
gattaactatcaagatgat

SEQ ID NO: 6269 - DNA, 19 bp, Artificial Sequence
  source: /note="Description of Artificial Sequence: Synthetic oligonucleotide"
ctatcaagatgatgcagaa

SEQ ID NO: 6270 - DNA, 19 bp, Artificial Sequence
  source: /note="Description of Artificial Sequence: Synthetic oligonucleotide"
gaatacaaatgatgtagaa

SEQ ID NO: 6271 - DNA, 19 bp, Artificial Sequence
  source: /note="Description of Artificial Sequence: Synthetic oligonucleotide"
tgttggattgattcgaaat

SEQ ID NO: 6272 - DNA, 19 bp, Artificial Sequence
  source: /note="Description of Artificial Sequence: Synthetic oligonucleotide"
gggtccgcatggaagaaat

SEQ ID NO: 6273 - DNA, 19 bp, Artificial Sequence
  source: /note="Description of Artificial Sequence: Synthetic oligonucleotide"
tcctagctatcgttctttt

SEQ ID NO: 6274 - DNA, 19 bp, Artificial Sequence
  source: /note="Description of Artificial Sequence: Synthetic oligonucleotide"
aagtgaagaatgcacaaga

SEQ ID NO: 6275 - DNA, 19 bp, Artificial Sequence
  source: /note="Description of Artificial Sequence: Synthetic oligonucleotide"
catgcagaatacaaatgat

SEQ ID NO: 6276 - DNA, 19 bp, Artificial Sequence
  source: /note="Description of Artificial Sequence: Synthetic oligonucleotide"
actgttggattgattcgaa

SEQ ID NO: 6277 - DNA, 19 bp, Artificial Sequence
  source: /note="Description of Artificial Sequence: Synthetic oligonucleotide"
gaccccaagctttagtaaa

SEQ ID NO: 6278 - DNA, 19 bp, Artificial Sequence
  source: /note="Description of Artificial Sequence: Synthetic oligonucleotide"
agccttgcttgttaaattt

SEQ ID NO: 6279 - DNA, 19 bp, Artificial Sequence
  source: /note="Description of Artificial Sequence: Synthetic oligonucleotide"
ttcagatgctgcaactaaa

SEQ ID NO: 6280 - DNA, 19 bp, Artificial Sequence
  source: /note="Description of Artificial Sequence: Synthetic oligonucleotide"
atcacaagatggaatttat

SEQ ID NO: 6281 - DNA, 19 bp, Artificial Sequence
  source: /note="Description of Artificial Sequence: Synthetic oligonucleotide"
aatagaaaatggtccaatt

SEQ ID NO: 6282 - DNA, 19 bp, Artificial Sequence
  source: /note="Description of Artificial Sequence: Synthetic oligonucleotide"
gatggtgtctgctattgta

SEQ ID NO: 6283 - DNA, 19 bp, Artificial Sequence
  source: /note="Description of Artificial Sequence: Synthetic oligonucleotide"
ccaagctttagtaaatata

SEQ ID NO: 6284 - DNA, 19 bp, Artificial Sequence
  source: /note="Description of Artificial Sequence: Synthetic oligonucleotide"
caagctttagtaaatataa

SEQ ID NO: 6285 - DNA, 19 bp, Artificial Sequence
  source: /note="Description of Artificial Sequence: Synthetic oligonucleotide"
ctctgacagagttacttca

SEQ ID NO: 6286 - DNA, 19 bp, Artificial Sequence
  source: /note="Description of Artificial Sequence: Synthetic oligonucleotide"
cagctggaattctttctaa

SEQ ID NO: 6287 - DNA, 19 bp, Artificial Sequence
  source: /note="Description of Artificial Sequence: Synthetic oligonucleotide"
gactaccagttgtggttaa

SEQ ID NO: 6288 - DNA, 19 bp, Artificial Sequence
  source: /note="Description of Artificial Sequence: Synthetic oligonucleotide"
ccatacaactgttttgaaa

SEQ ID NO: 6289 - DNA, 19 bp, Artificial Sequence
  source: /note="Description of Artificial Sequence: Synthetic oligonucleotide"
gattaactatcaagatgat

SEQ ID NO: 6290 - DNA, 19 bp, Artificial Sequence
  source: /note="Description of Artificial Sequence: Synthetic oligonucleotide"
ctatcaagatgatgcagaa

SEQ ID NO: 6291 - DNA, 19 bp, Artificial Sequence
  source: /note="Description of Artificial Sequence: Synthetic oligonucleotide"
gaatacaaatgatgtagaa

SEQ ID NO: 6292 - DNA, 19 bp, Artificial Sequence
  source: /note="Description of Artificial Sequence: Synthetic oligonucleotide"
tgttggattgattcgaaat

SEQ ID NO: 6293 - DNA, 19 bp, Artificial Sequence
  source: /note="Description of Artificial Sequence: Synthetic oligonucleotide"
gggtccgcatggaagaaat

SEQ ID NO: 6294 - DNA, 19 bp, Artificial Sequence
  source: /note="Description of Artificial Sequence: Synthetic oligonucleotide"
tcctagctatcgttctttt

SEQ ID NO: 6295 - DNA, 19 bp, Artificial Sequence
  source: /note="Description of Artificial Sequence: Synthetic oligonucleotide"
aagtgaagaatgcacaaga

SEQ ID NO: 6296 - DNA, 19 bp, Artificial Sequence
  source: /note="Description of Artificial Sequence: Synthetic oligonucleotide"
catgcagaatacaaatgat

SEQ ID NO: 6297 - DNA, 19 bp, Artificial Sequence
  source: /note="Description of Artificial Sequence: Synthetic oligonucleotide"
actgttggattgattcgaa

SEQ ID NO: 6298 - DNA, 19 bp, Artificial Sequence
  source: /note="Description of Artificial Sequence: Synthetic oligonucleotide"
gaccccaagctttagtaaa

SEQ ID NO: 6299 - DNA, 19 bp, Artificial Sequence
  source: /note="Description of Artificial Sequence: Synthetic oligonucleotide"
agccttgcttgttaaattt

SEQ ID NO: 6300 - DNA, 19 bp, Artificial Sequence
  source: /note="Description of Artificial Sequence: Synthetic oligonucleotide"
ttcagatgctgcaactaaa

SEQ ID NO: 6301 - DNA, 19 bp, Artificial Sequence
  source: /note="Description of Artificial Sequence: Synthetic oligonucleotide"
atcacaagatggaatttat

SEQ ID NO: 6302 - DNA, 19 bp, Artificial Sequence
  source: /note="Description of Artificial Sequence: Synthetic oligonucleotide"
aatagaaaatggtccaatt

SEQ ID NO: 6303 - DNA, 19 bp, Artificial Sequence
  source: /note="Description of Artificial Sequence: Synthetic oligonucleotide"
gatggtgtctgctattgta

SEQ ID NO: 6304 - DNA, 19 bp, Artificial Sequence
  source: /note="Description of Artificial Sequence: Synthetic oligonucleotide"
ccaagctttagtaaatata

SEQ ID NO: 6305 - DNA, 19 bp, Artificial Sequence
  source: /note="Description of Artificial Sequence: Synthetic oligonucleotide"
caagctttagtaaatataa

SEQ ID NO: 6306 - DNA, 19 bp, Artificial Sequence
  source: /note="Description of Artificial Sequence: Synthetic oligonucleotide"
ctctgacagagttacttca

SEQ ID NO: 6307 - DNA, 19 bp, Artificial Sequence
  source: /note="Description of Artificial Sequence: Synthetic oligonucleotide"
cagctggaattctttctaa

SEQ ID NO: 6308 - DNA, 19 bp, Artificial Sequence
  source: /note="Description of Artificial Sequence: Synthetic oligonucleotide"
gactaccagttgtggttaa

SEQ ID NO: 6309 - DNA, 19 bp, Artificial Sequence
  source: /note="Description of Artificial Sequence: Synthetic oligonucleotide"
tttcaaaacagttgtatgg

SEQ ID NO: 6310 - DNA, 19 bp, Artificial Sequence
  source: /note="Description of Artificial Sequence: Synthetic oligonucleotide"
atcatcttgatagttaatc

SEQ ID NO: 6311 - DNA, 19 bp, Artificial Sequence
  source: /note="Description of Artificial Sequence: Synthetic oligonucleotide"
ttctgcatcatcttgatag

SEQ ID NO: 6312 - DNA, 19 bp, Artificial Sequence
  source: /note="Description of Artificial Sequence: Synthetic oligonucleotide"
ttctacatcatttgtattc

SEQ ID NO: 6313 - DNA, 19 bp, Artificial Sequence
  source: /note="Description of Artificial Sequence: Synthetic oligonucleotide"
atttcgaatcaatccaaca

SEQ ID NO: 6314 - DNA, 19 bp, Artificial Sequence
  source: /note="Description of Artificial Sequence: Synthetic oligonucleotide"
atttcttccatgcggaccc

SEQ ID NO: 6315 - DNA, 19 bp, Artificial Sequence
  source: /note="Description of Artificial Sequence: Synthetic oligonucleotide"
aaaagaacgatagctagga

SEQ ID NO: 6316 - DNA, 19 bp, Artificial Sequence
  source: /note="Description of Artificial Sequence: Synthetic oligonucleotide"
tcttgtgcattcttcactt

SEQ ID NO: 6317 - DNA, 19 bp, Artificial Sequence
  source: /note="Description of Artificial Sequence: Synthetic oligonucleotide"
atcatttgtattctgcatg

SEQ ID NO: 6318 - DNA, 19 bp, Artificial Sequence
  source: /note="Description of Artificial Sequence: Synthetic oligonucleotide"
ttcgaatcaatccaacagt

SEQ ID NO: 6319 - DNA, 19 bp, Artificial Sequence
  source: /note="Description of Artificial Sequence: Synthetic oligonucleotide"
tttactaaagcttggggtc

SEQ ID NO: 6320 - DNA, 19 bp, Artificial Sequence
  source: /note="Description of Artificial Sequence: Synthetic oligonucleotide"
aaatttaacaagcaaggct

SEQ ID NO: 6321 - DNA, 19 bp, Artificial Sequence
  source: /note="Description of Artificial Sequence: Synthetic oligonucleotide"
tttagttgcagcatctgaa

SEQ ID NO: 6322 - DNA, 19 bp, Artificial Sequence
  source: /note="Description of Artificial Sequence: Synthetic oligonucleotide"
ataaattccatcttgtgat

SEQ ID NO: 6323 - DNA, 19 bp, Artificial Sequence
  source: /note="Description of Artificial Sequence: Synthetic oligonucleotide"
aattggaccattttctatt

SEQ ID NO: 6324 - DNA, 19 bp, Artificial Sequence
  source: /note="Description of Artificial Sequence: Synthetic oligonucleotide"
tacaatagcagacaccatc

SEQ ID NO: 6325 - DNA, 19 bp, Artificial Sequence
  source: /note="Description of Artificial Sequence: Synthetic oligonucleotide"
tatatttactaaagcttgg

SEQ ID NO: 6326 - DNA, 19 bp, Artificial Sequence
  source: /note="Description of Artificial Sequence: Synthetic oligonucleotide"
ttatatttactaaagcttg

SEQ ID NO: 6327 - DNA, 19 bp, Artificial Sequence
  source: /note="Description of Artificial Sequence: Synthetic oligonucleotide"
tgaagtaactctgtcagag

SEQ ID NO: 6328 - DNA, 19 bp, Artificial Sequence
  source: /note="Description of Artificial Sequence: Synthetic oligonucleotide"
ttagaaagaattccagctg

SEQ ID NO: 6329 - DNA, 19 bp, Artificial Sequence
  source: /note="Description of Artificial Sequence: Synthetic oligonucleotide"
ttaaccacaactggtagtc

SEQ ID NO: 6330 - DNA, 19 bp, Artificial Sequence
  source: /note="Description of Artificial Sequence: Synthetic oligonucleotide"
tttcaaaacagttgtatgg

SEQ ID NO: 6331 - DNA, 19 bp, Artificial Sequence
  source: /note="Description of Artificial Sequence: Synthetic oligonucleotide"
atcatcttgatagttaatc

SEQ ID NO: 6332 - DNA, 19 bp, Artificial Sequence
  source: /note="Description of Artificial Sequence: Synthetic oligonucleotide"
ttctgcatcatcttgatag

SEQ ID NO: 6333 - DNA, 19 bp, Artificial Sequence
  source: /note="Description of Artificial Sequence: Synthetic oligonucleotide"
ttctacatcatttgtattc

SEQ ID NO: 6334 - DNA, 19 bp, Artificial Sequence
  source: /note="Description of Artificial Sequence: Synthetic oligonucleotide"
atttcgaatcaatccaaca

SEQ ID NO: 6335 - DNA, 19 bp, Artificial Sequence
  source: /note="Description of Artificial Sequence: Synthetic oligonucleotide"
atttcttccatgcggaccc

SEQ ID NO: 6336 - DNA, 19 bp, Artificial Sequence
  source: /note="Description of Artificial Sequence: Synthetic oligonucleotide"
aaaagaacgatagctagga

SEQ ID NO: 6337 - DNA, 19 bp, Artificial Sequence
  source: /note="Description of Artificial Sequence: Synthetic oligonucleotide"
tcttgtgcattcttcactt

SEQ ID NO: 6338 - DNA, 19 bp, Artificial Sequence
  source: /note="Description of Artificial Sequence: Synthetic oligonucleotide"
atcatttgtattctgcatg

SEQ ID NO: 6339 - DNA, 19 bp, Artificial Sequence
  source: /note="Description of Artificial Sequence: Synthetic oligonucleotide"
ttcgaatcaatccaacagt

SEQ ID NO: 6340 - DNA, 19 bp, Artificial Sequence
  source: /note="Description of Artificial Sequence: Synthetic oligonucleotide"
tttactaaagcttggggtc

SEQ ID NO: 6341 - DNA, 19 bp, Artificial Sequence
  source: /note="Description of Artificial Sequence: Synthetic oligonucleotide"
aaatttaacaagcaaggct

SEQ ID NO: 6342 - DNA, 19 bp, Artificial Sequence
  source: /note="Description of Artificial Sequence: Synthetic oligonucleotide"
tttagttgcagcatctgaa

SEQ ID NO: 6343 - DNA, 19 bp, Artificial Sequence
  source: /note="Description of Artificial Sequence: Synthetic oligonucleotide"
ataaattccatcttgtgat

SEQ ID NO: 6344 - DNA, 19 bp, Artificial Sequence
  source: /note="Description of Artificial Sequence: Synthetic oligonucleotide"
aattggaccattttctatt

SEQ ID NO: 6345 - DNA, 19 bp, Artificial Sequence
  source: /note="Description of Artificial Sequence: Synthetic oligonucleotide"
tacaatagcagacaccatc

SEQ ID NO: 6346 - DNA, 19 bp, Artificial Sequence
  source: /note="Description of Artificial Sequence: Synthetic oligonucleotide"
tatatttactaaagcttgg

SEQ ID NO: 6347 - DNA, 19 bp, Artificial Sequence
  source: /note="Description of Artificial Sequence: Synthetic oligonucleotide"
ttatatttactaaagcttg

SEQ ID NO: 6348 - DNA, 19 bp, Artificial Sequence
  source: /note="Description of Artificial Sequence: Synthetic oligonucleotide"
tgaagtaactctgtcagag

SEQ ID NO: 6349 - DNA, 19 bp, Artificial Sequence
  source: /note="Description of Artificial Sequence: Synthetic oligonucleotide"
ttagaaagaattccagctg

SEQ ID NO: 6350 - DNA, 19 bp, Artificial Sequence
  source: /note="Description of Artificial Sequence: Synthetic oligonucleotide"
ttaaccacaactggtagtc

SEQ ID NO: 6351 - DNA, 19 bp, Artificial Sequence
  source: /note="Description of Artificial Sequence: Synthetic oligonucleotide"
tttcaaaacagttgtatgg

SEQ ID NO: 6352 - DNA, 19 bp, Artificial Sequence
  source: /note="Description of Artificial Sequence: Synthetic oligonucleotide"
atcatcttgatagttaatc

SEQ ID NO: 6353 - DNA, 19 bp, Artificial Sequence
  source: /note="Description of Artificial Sequence: Synthetic oligonucleotide"
ttctgcatcatcttgatag

SEQ ID NO: 6354 - DNA, 19 bp, Artificial Sequence
  source: /note="Description of Artificial Sequence: Synthetic oligonucleotide"
ttctacatcatttgtattc

SEQ ID NO: 6355 - DNA, 19 bp, Artificial Sequence
  source: /note="Description of Artificial Sequence: Synthetic oligonucleotide"
atttcgaatcaatccaaca

SEQ ID NO: 6356 - DNA, 19 bp, Artificial Sequence
  source: /note="Description of Artificial Sequence: Synthetic oligonucleotide"
atttcttccatgcggaccc

SEQ ID NO: 6357 - DNA, 19 bp, Artificial Sequence
  source: /note="Description of Artificial Sequence: Synthetic oligonucleotide"
aaaagaacgatagctagga

SEQ ID NO: 6358 - DNA, 19 bp, Artificial Sequence
  source: /note="Description of Artificial Sequence: Synthetic oligonucleotide"
tcttgtgcattcttcactt

SEQ ID NO: 6359 - DNA, 19 bp, Artificial Sequence
  source: /note="Description of Artificial Sequence: Synthetic oligonucleotide"
atcatttgtattctgcatg

SEQ ID NO: 6360 - DNA, 19 bp, Artificial Sequence
  source: /note="Description of Artificial Sequence: Synthetic oligonucleotide"
ttcgaatcaatccaacagt

SEQ ID NO: 6361 - DNA, 19 bp, Artificial Sequence
  source: /note="Description of Artificial Sequence: Synthetic oligonucleotide"
tttactaaagcttggggtc

SEQ ID NO: 6362 - DNA, 19 bp, Artificial Sequence
  source: /note="Description of Artificial Sequence: Synthetic oligonucleotide"
aaatttaacaagcaaggct

SEQ ID NO: 6363 - DNA, 19 bp, Artificial Sequence
  source: /note="Description of Artificial Sequence: Synthetic oligonucleotide"
tttagttgcagcatctgaa

SEQ ID NO: 6364 - DNA, 19 bp, Artificial Sequence
  source: /note="Description of Artificial Sequence: Synthetic oligonucleotide"
ataaattccatcttgtgat

SEQ ID NO: 6365 - DNA, 19 bp, Artificial Sequence
  source: /note="Description of Artificial Sequence: Synthetic oligonucleotide"
aattggaccattttctatt

SEQ ID NO: 6366 - DNA, 19 bp, Artificial Sequence
  source: /note="Description of Artificial Sequence: Synthetic oligonucleotide"
tacaatagcagacaccatc

SEQ ID NO: 6367 - DNA, 19 bp, Artificial Sequence
  source: /note="Description of Artificial Sequence: Synthetic oligonucleotide"
tatatttactaaagcttgg

SEQ ID NO: 6368 - DNA, 19 bp, Artificial Sequence
  source: /note="Description of Artificial Sequence: Synthetic oligonucleotide"
ttatatttactaaagcttg

SEQ ID NO: 6369 - DNA, 19 bp, Artificial Sequence
  source: /note="Description of Artificial Sequence: Synthetic oligonucleotide"
tgaagtaactctgtcagag

SEQ ID NO: 6370 - DNA, 19 bp, Artificial Sequence
  source: /note="Description of Artificial Sequence: Synthetic oligonucleotide"
ttagaaagaattccagctg

SEQ ID NO: 6371 - DNA, 19 bp, Artificial Sequence
  source: /note="Description of Artificial Sequence: Synthetic oligonucleotide"
ttaaccacaactggtagtc

SEQ ID NO: 6372 - DNA, 19 bp, Artificial Sequence
  source: /note="Description of Artificial Sequence: Synthetic oligonucleotide"
tttcaaaacagttgtatgg

SEQ ID NO: 6373 - DNA, 19 bp, Artificial Sequence
  source: /note="Description of Artificial Sequence: Synthetic oligonucleotide"
atcatcttgatagttaatc

SEQ ID NO: 6374 - DNA, 19 bp, Artificial Sequence
  source: /note="Description of Artificial Sequence: Synthetic oligonucleotide"
ttctgcatcatcttgatag

SEQ ID NO: 6375 - DNA, 19 bp, Artificial Sequence
  source: /note="Description of Artificial Sequence: Synthetic oligonucleotide"
ttctacatcatttgtattc

SEQ ID NO: 6376 - DNA, 19 bp, Artificial Sequence
  source: /note="Description of Artificial Sequence: Synthetic oligonucleotide"
atttcgaatcaatccaaca

SEQ ID NO: 6377 - DNA, 19 bp, Artificial Sequence
  source: /note="Description of Artificial Sequence: Synthetic oligonucleotide"
atttcttccatgcggaccc

SEQ ID NO: 6378 - DNA, 19 bp, Artificial Sequence
  source: /note="Description of Artificial Sequence: Synthetic oligonucleotide"
aaaagaacgatagctagga

SEQ ID NO: 6379 - DNA, 19 bp, Artificial Sequence
  source: /note="Description of Artificial Sequence: Synthetic oligonucleotide"
tcttgtgcattcttcactt

SEQ ID NO: 6380 - DNA, 19 bp, Artificial Sequence
  source: /note="Description of Artificial Sequence: Synthetic oligonucleotide"
atcatttgtattctgcatg

SEQ ID NO: 6381 - DNA, 19 bp, Artificial Sequence
  source: /note="Description of Artificial Sequence: Synthetic oligonucleotide"
ttcgaatcaatccaacagt

SEQ ID NO: 6382 - DNA, 19 bp, Artificial Sequence
  source: /note="Description of Artificial Sequence: Synthetic oligonucleotide"
tttactaaagcttggggtc

SEQ ID NO: 6383 - DNA, 19 bp, Artificial Sequence
  source: /note="Description of Artificial Sequence: Synthetic oligonucleotide"
aaatttaacaagcaaggct

SEQ ID NO: 6384 - DNA, 19 bp, Artificial Sequence
  source: /note="Description of Artificial Sequence: Synthetic oligonucleotide"
tttagttgcagcatctgaa

SEQ ID NO: 6385 - DNA, 19 bp, Artificial Sequence
  source: /note="Description of Artificial Sequence: Synthetic oligonucleotide"
ataaattccatcttgtgat

SEQ ID NO: 6386 - DNA, 19 bp, Artificial Sequence
  source: /note="Description of Artificial Sequence: Synthetic oligonucleotide"
aattggaccattttctatt

SEQ ID NO: 6387 - DNA, 19 bp, Artificial Sequence
  source: /note="Description of Artificial Sequence: Synthetic oligonucleotide"
tacaatagcagacaccatc

SEQ ID NO: 6388 - DNA, 19 bp, Artificial Sequence
  source: /note="Description of Artificial Sequence: Synthetic oligonucleotide"
tatatttactaaagcttgg

SEQ ID NO: 6389 - DNA, 19 bp, Artificial Sequence
  source: /note="Description of Artificial Sequence: Synthetic oligonucleotide"
ttatatttactaaagcttg

SEQ ID NO: 6390 - DNA, 19 bp, Artificial Sequence
  source: /note="Description of Artificial Sequence: Synthetic oligonucleotide"
tgaagtaactctgtcagag

SEQ ID NO: 6391 - DNA, 19 bp, Artificial Sequence
  source: /note="Description of Artificial Sequence: Synthetic oligonucleotide"
ttagaaagaattccagctg

SEQ ID NO: 6392 - DNA, 19 bp, Artificial Sequence
  source: /note="Description of Artificial Sequence: Synthetic oligonucleotide"
ttaaccacaactggtagtc

SEQ ID NO: 6393 - DNA, 19 bp, Artificial Sequence
  source: /note="Description of Artificial Sequence: Synthetic oligonucleotide"
tttcaaaacagttgtatgg

SEQ ID NO: 6394 - DNA, 19 bp, Artificial Sequence
  source: /note="Description of Artificial Sequence: Synthetic oligonucleotide"
atcatcttgatagttaatc

SEQ ID NO: 6395 - DNA, 19 bp, Artificial Sequence
  source: /note="Description of Artificial Sequence: Synthetic oligonucleotide"
ttctgcatcatcttgatag

SEQ ID NO: 6396 - DNA, 19 bp, Artificial Sequence
  source: /note="Description of Artificial Sequence: Synthetic oligonucleotide"
ttctacatcatttgtattc

SEQ ID NO: 6397 - DNA, 19 bp, Artificial Sequence
  source: /note="Description of Artificial Sequence: Synthetic oligonucleotide"
atttcgaatcaatccaaca

SEQ ID NO: 6398 - DNA, 19 bp, Artificial Sequence
  source: /note="Description of Artificial Sequence: Synthetic oligonucleotide"
atttcttccatgcggaccc

SEQ ID NO: 6399 - DNA, 19 bp, Artificial Sequence
  source: /note="Description of Artificial Sequence: Synthetic oligonucleotide"
aaaagaacgatagctagga

SEQ ID NO: 6400 - DNA, 19 bp, Artificial Sequence
  source: /note="Description of Artificial Sequence: Synthetic oligonucleotide"
tcttgtgcattcttcactt

SEQ ID NO: 6401 - DNA, 19 bp, Artificial Sequence
  source: /note="Description of Artificial Sequence: Synthetic oligonucleotide"
atcatttgtattctgcatg

SEQ ID NO: 6402 - DNA, 19 bp, Artificial Sequence
  source: /note="Description of Artificial Sequence: Synthetic oligonucleotide"
ttcgaatcaatccaacagt

SEQ ID NO: 6403 - DNA, 19 bp, Artificial Sequence
  source: /note="Description of Artificial Sequence: Synthetic oligonucleotide"
tttactaaagcttggggtc

SEQ ID NO: 6404 - DNA, 19 bp, Artificial Sequence
  source: /note="Description of Artificial Sequence: Synthetic oligonucleotide"
aaatttaacaagcaaggct

SEQ ID NO: 6405 - DNA, 19 bp, Artificial Sequence
  source: /note="Description of Artificial Sequence: Synthetic oligonucleotide"
tttagttgcagcatctgaa

SEQ ID NO: 6406 - DNA, 19 bp, Artificial Sequence
  source: /note="Description of Artificial Sequence: Synthetic oligonucleotide"
ataaattccatcttgtgat

SEQ ID NO: 6407 - DNA, 19 bp, Artificial Sequence
  source: /note="Description of Artificial Sequence: Synthetic oligonucleotide"
aattggaccattttctatt

SEQ ID NO: 6408 - DNA, 19 bp, Artificial Sequence
  source: /note="Description of Artificial Sequence: Synthetic oligonucleotide"
tacaatagcagacaccatc

SEQ ID NO: 6409 - DNA, 19 bp, Artificial Sequence
  source: /note="Description of Artificial Sequence: Synthetic oligonucleotide"
tatatttactaaagcttgg

SEQ ID NO: 6410 - DNA, 19 bp, Artificial Sequence
  source: /note="Description of Artificial Sequence: Synthetic oligonucleotide"
ttatatttactaaagcttg

SEQ ID NO: 6411 - DNA, 19 bp, Artificial Sequence
  source: /note="Description of Artificial Sequence: Synthetic oligonucleotide"
tgaagtaactctgtcagag

SEQ ID NO: 6412 - DNA, 19 bp, Artificial Sequence
  source: /note="Description of Artificial Sequence: Synthetic oligonucleotide"
ttagaaagaattccagctg

SEQ ID NO: 6413 - DNA, 19 bp, Artificial Sequence
  source: /note="Description of Artificial Sequence: Synthetic oligonucleotide"
ttaaccacaactggtagtc

SEQ ID NO: 6414 - DNA, 19 bp, Artificial Sequence
  source: /note="Description of Artificial Sequence: Synthetic oligonucleotide"
tttcaaaacagttgtatgg

SEQ ID NO: 6415 - DNA, 19 bp, Artificial Sequence
  source: /note="Description of Artificial Sequence: Synthetic oligonucleotide"
atcatcttgatagttaatc

SEQ ID NO: 6416 - DNA, 19 bp, Artificial Sequence
  source: /note="Description of Artificial Sequence: Synthetic oligonucleotide"
ttctgcatcatcttgatag

SEQ ID NO: 6417 - DNA, 19 bp, Artificial Sequence
  source: /note="Description of Artificial Sequence: Synthetic oligonucleotide"
ttctacatcatttgtattc

SEQ ID NO: 6418 - DNA, 19 bp, Artificial Sequence
  source: /note="Description of Artificial Sequence: Synthetic oligonucleotide"
atttcgaatcaatccaaca

SEQ ID NO: 6419 - DNA, 19 bp, Artificial Sequence
  source: /note="Description of Artificial Sequence: Synthetic oligonucleotide"
atttcttccatgcggaccc

SEQ ID NO: 6420 - DNA, 19 bp, Artificial Sequence
  source: /note="Description of Artificial Sequence: Synthetic oligonucleotide"
aaaagaacgatagctagga

SEQ ID NO: 6421 - DNA, 19 bp, Artificial Sequence
  source: /note="Description of Artificial Sequence: Synthetic oligonucleotide"
tcttgtgcattcttcactt

SEQ ID NO: 6422 - DNA, 19 bp, Artificial Sequence
  source: /note="Description of Artificial Sequence: Synthetic oligonucleotide"
atcatttgtattctgcatg

SEQ ID NO: 6423 - DNA, 19 bp, Artificial Sequence
  source: /note="Description of Artificial Sequence: Synthetic oligonucleotide"
ttcgaatcaatccaacagt

SEQ ID NO: 6424 - DNA, 19 bp, Artificial Sequence
  source: /note="Description of Artificial Sequence: Synthetic oligonucleotide"
tttactaaagcttggggtc

SEQ ID NO: 6425 - DNA, 19 bp, Artificial Sequence
  source: /note="Description of Artificial Sequence: Synthetic oligonucleotide"
aaatttaacaagcaaggct

SEQ ID NO: 6426 - DNA, 19 bp, Artificial Sequence
  source: /note="Description of Artificial Sequence: Synthetic oligonucleotide"
tttagttgcagcatctgaa

SEQ ID NO: 6427 - DNA, 19 bp, Artificial Sequence
  source: /note="Description of Artificial Sequence: Synthetic oligonucleotide"
ataaattccatcttgtgat

SEQ ID NO: 6428 - DNA, 19 bp, Artificial Sequence
  source: /note="Description of Artificial Sequence: Synthetic oligonucleotide"
aattggaccattttctatt

SEQ ID NO: 6429 - DNA, 19 bp, Artificial Sequence
  source: /note="Description of Artificial Sequence: Synthetic oligonucleotide"
tacaatagcagacaccatc

SEQ ID NO: 6430 - DNA, 19 bp, Artificial Sequence
  source: /note="Description of Artificial Sequence: Synthetic oligonucleotide"
tatatttactaaagcttgg

SEQ ID NO: 6431 - DNA, 19 bp, Artificial Sequence
  source: /note="Description of Artificial Sequence: Synthetic oligonucleotide"
ttatatttactaaagcttg

SEQ ID NO: 6432 - DNA, 19 bp, Artificial Sequence
  source: /note="Description of Artificial Sequence: Synthetic oligonucleotide"
tgaagtaactctgtcagag

SEQ ID NO: 6433 - DNA, 19 bp, Artificial Sequence
  source: /note="Description of Artificial Sequence: Synthetic oligonucleotide"
ttagaaagaattccagctg

SEQ ID NO: 6434 - DNA, 19 bp, Artificial Sequence
  source: /note="Description of Artificial Sequence: Synthetic oligonucleotide"
ttaaccacaactggtagtc

SEQ ID NO: 6435 - DNA, 19 bp, Artificial Sequence
  source: /note="Description of Artificial Sequence: Synthetic oligonucleotide"
tttcaaaacagttgtatgg

SEQ ID NO: 6436 - DNA, 19 bp, Artificial Sequence
  source: /note="Description of Artificial Sequence: Synthetic oligonucleotide"
atcatcttgatagttaatc

SEQ ID NO: 6437 - DNA, 19 bp, Artificial Sequence
  source: /note="Description of Artificial Sequence: Synthetic oligonucleotide"
ttctgcatcatcttgatag

SEQ ID NO: 6438 - DNA, 19 bp, Artificial Sequence
  source: /note="Description of Artificial Sequence: Synthetic oligonucleotide"
ttctacatcatttgtattc

SEQ ID NO: 6439 - DNA, 19 bp, Artificial Sequence
  source: /note="Description of Artificial Sequence: Synthetic oligonucleotide"
atttcgaatcaatccaaca

SEQ ID NO: 6440 - DNA, 19 bp, Artificial Sequence
  source: /note="Description of Artificial Sequence: Synthetic oligonucleotide"
atttcttccatgcggaccc

SEQ ID NO: 6441 - DNA, 19 bp, Artificial Sequence
  source: /note="Description of Artificial Sequence: Synthetic oligonucleotide"
aaaagaacgatagctagga

SEQ ID NO: 6442 - DNA, 19 bp, Artificial Sequence
  source: /note="Description of Artificial Sequence: Synthetic oligonucleotide"
tcttgtgcattcttcactt

SEQ ID NO: 6443 - DNA, 19 bp, Artificial Sequence
  source: /note="Description of Artificial Sequence: Synthetic oligonucleotide"
atcatttgtattctgcatg

SEQ ID NO: 6444 - DNA, 19 bp, Artificial Sequence
  source: /note="Description of Artificial Sequence: Synthetic oligonucleotide"
ttcgaatcaatccaacagt

SEQ ID NO: 6445 - DNA, 19 bp, Artificial Sequence
  source: /note="Description of Artificial Sequence: Synthetic oligonucleotide"
tttactaaagcttggggtc

SEQ ID NO: 6446 - DNA, 19 bp, Artificial Sequence
  source: /note="Description of Artificial Sequence: Synthetic oligonucleotide"
aaatttaacaagcaaggct

SEQ ID NO: 6447 - DNA, 19 bp, Artificial Sequence
  source: /note="Description of Artificial Sequence: Synthetic oligonucleotide"
tttagttgcagcatctgaa

SEQ ID NO: 6448 - DNA, 19 bp, Artificial Sequence
  source: /note="Description of Artificial Sequence: Synthetic oligonucleotide"
ataaattccatcttgtgat

SEQ ID NO: 6449 - DNA, 19 bp, Artificial Sequence
  source: /note="Description of Artificial Sequence: Synthetic oligonucleotide"
aattggaccattttctatt

SEQ ID NO: 6450 - DNA, 19 bp, Artificial Sequence
  source: /note="Description of Artificial Sequence: Synthetic oligonucleotide"
tacaatagcagacaccatc

SEQ ID NO: 6451 - DNA, 19 bp, Artificial Sequence
  source: /note="Description of Artificial Sequence: Synthetic oligonucleotide"
tatatttactaaagcttgg

SEQ ID NO: 6452 - DNA, 19 bp, Artificial Sequence
  source: /note="Description of Artificial Sequence: Synthetic oligonucleotide"
ttatatttactaaagcttg

SEQ ID NO: 6453 - DNA, 19 bp, Artificial Sequence
  source: /note="Description of Artificial Sequence: Synthetic oligonucleotide"
tgaagtaactctgtcagag

SEQ ID NO: 6454 - DNA, 19 bp, Artificial Sequence
  source: /note="Description of Artificial Sequence: Synthetic oligonucleotide"
ttagaaagaattccagctg

SEQ ID NO: 6455 - DNA, 19 bp, Artificial Sequence
  source: /note="Description of Artificial Sequence: Synthetic oligonucleotide"
ttaaccacaactggtagtc

SEQ ID NO: 6456 - DNA, 19 bp, Artificial Sequence
  source: /note="Description of Artificial Sequence: Synthetic oligonucleotide"
tttcaaaacagttgtatgg

SEQ ID NO: 6457 - DNA, 19 bp, Artificial Sequence
  source: /note="Description of Artificial Sequence: Synthetic oligonucleotide"
atcatcttgatagttaatc

SEQ ID NO: 6458 - DNA, 19 bp, Artificial Sequence
  source: /note="Description of Artificial Sequence: Synthetic oligonucleotide"
ttctgcatcatcttgatag

SEQ ID NO: 6459 - DNA, 19 bp, Artificial Sequence
  source: /note="Description of Artificial Sequence: Synthetic oligonucleotide"
ttctacatcatttgtattc

SEQ ID NO: 6460 - DNA, 19 bp, Artificial Sequence
  source: /note="Description of Artificial Sequence: Synthetic oligonucleotide"
atttcgaatcaatccaaca

SEQ ID NO: 6461 - DNA, 19 bp, Artificial Sequence
  source: /note="Description of Artificial Sequence: Synthetic oligonucleotide"
atttcttccatgcggaccc

SEQ ID NO: 6462 - DNA, 19 bp, Artificial Sequence
  source: /note="Description of Artificial Sequence: Synthetic oligonucleotide"
aaaagaacgatagctagga

SEQ ID NO: 6463 - DNA, 19 bp, Artificial Sequence
  source: /note="Description of Artificial Sequence: Synthetic oligonucleotide"
tcttgtgcattcttcactt

SEQ ID NO: 6464 - DNA, 19 bp, Artificial Sequence
  source: /note="Description of Artificial Sequence: Synthetic oligonucleotide"
atcatttgtattctgcatg

SEQ ID NO: 6465 - DNA, 19 bp, Artificial Sequence
  source: /note="Description of Artificial Sequence: Synthetic oligonucleotide"
ttcgaatcaatccaacagt

SEQ ID NO: 6466 - DNA, 19 bp, Artificial Sequence
  source: /note="Description of Artificial Sequence: Synthetic oligonucleotide"
tttactaaagcttggggtc

SEQ ID NO: 6467 - DNA, 19 bp, Artificial Sequence
  source: /note="Description of Artificial Sequence: Synthetic oligonucleotide"
aaatttaacaagcaaggct

SEQ ID NO: 6468 - DNA, 19 bp, Artificial Sequence
  source: /note="Description of Artificial Sequence: Synthetic oligonucleotide"
tttagttgcagcatctgaa

SEQ ID NO: 6469 - DNA, 19 bp, Artificial Sequence
  source: /note="Description of Artificial Sequence: Synthetic oligonucleotide"
ataaattccatcttgtgat

SEQ ID NO: 6470 - DNA, 19 bp, Artificial Sequence
  source: /note="Description of Artificial Sequence: Synthetic oligonucleotide"
aattggaccattttctatt

SEQ ID NO: 6471 - DNA, 19 bp, Artificial Sequence
  source: /note="Description of Artificial Sequence: Synthetic oligonucleotide"
tacaatagcagacaccatc

SEQ ID NO: 6472 - DNA, 19 bp, Artificial Sequence
  source: /note="Description of Artificial Sequence: Synthetic oligonucleotide"
tatatttactaaagcttgg

SEQ ID NO: 6473 - DNA, 19 bp, Artificial Sequence
  source: /note="Description of Artificial Sequence: Synthetic oligonucleotide"
ttatatttactaaagcttg

SEQ ID NO: 6474 - DNA, 19 bp, Artificial Sequence
  source: /note="Description of Artificial Sequence: Synthetic oligonucleotide"
tgaagtaactctgtcagag

SEQ ID NO: 6475 - DNA, 19 bp, Artificial Sequence
  source: /note="Description of Artificial Sequence: Synthetic oligonucleotide"
ttagaaagaattccagctg

SEQ ID NO: 6476 - DNA, 19 bp, Artificial Sequence
  source: /note="Description of Artificial Sequence: Synthetic oligonucleotide"
ttaaccacaactggtagtc

SEQ ID NO: 6477 - RNA, 21 nt, Artificial Sequence
  source: /note="Description of Artificial Sequence: Synthetic oligonucleotide"
uguuggauugauucgaaauuu

SEQ ID NO: 6478 - RNA, 21 nt, Artificial Sequence
  source: /note="Description of Artificial Sequence: Synthetic oligonucleotide"
aauagaaaaugguccaauuuu

SEQ ID NO: 6479 - RNA, 21 nt, Artificial Sequence
  source: /note="Description of Artificial Sequence: Synthetic oligonucleotide"
acuguuggauugauucgaauu

SEQ ID NO: 6480 - RNA, 21 nt, Artificial Sequence
  source: /note="Description of Artificial Sequence: Synthetic oligonucleotide"
cuaucaagaugaugcagaauu

SEQ ID NO: 6481 - RNA, 21 nt, Artificial Sequence
  source: /note="Description of Artificial Sequence: Synthetic oligonucleotide"
ccauacaacuguuuugaaauu

SEQ ID NO: 6482 - RNA, 21 nt, Artificial Sequence
  source: /note="Description of Artificial Sequence: Synthetic oligonucleotide"
aucacaagauggaauuuauuu

SEQ ID NO: 6483 - RNA, 21 nt, Artificial Sequence
  source: /note="Description of Artificial Sequence: Synthetic oligonucleotide"
aucaucuugauaguuaaucuu

SEQ ID NO: 6484 - RNA, 21 nt, Artificial Sequence
  source: /note="Description of Artificial Sequence: Synthetic oligonucleotide"
uccuagcuaucguucuuuuuu

SEQ ID NO: 6485 - RNA, 21 nt, Artificial Sequence
  source: /note="Description of Artificial Sequence: Synthetic oligonucleotide"
ggguccgcauggaagaaauuu

SEQ ID NO: 6486 - RNA, 21 nt, Artificial Sequence
  source: /note="Description of Artificial Sequence: Synthetic oligonucleotide"
auuucgaaucaauccaacauu

SEQ ID NO: 6487 - RNA, 21 nt, Artificial Sequence
  source: /note="Description of Artificial Sequence: Synthetic oligonucleotide"
aauuggaccauuuucuauuuu

SEQ ID NO: 6488 - RNA, 21 nt, Artificial Sequence
  source: /note="Description of Artificial Sequence: Synthetic oligonucleotide"
uucgaaucaauccaacaguuu

SEQ ID NO: 6489 - RNA, 21 nt, Artificial Sequence
  source: /note="Description of Artificial Sequence: Synthetic oligonucleotide"
uucugcaucaucuugauaguu

SEQ ID NO: 6490 - RNA, 21 nt, Artificial Sequence
  source: /note="Description of Artificial Sequence: Synthetic oligonucleotide"
uuucaaaacaguuguaugguu

SEQ ID NO: 6491 - RNA, 21 nt, Artificial Sequence
  source: /note="Description of Artificial Sequence: Synthetic oligonucleotide"
auaaauuccaucuugugauuu

SEQ ID NO: 6492 - RNA, 21 nt, Artificial Sequence
  source: /note="Description of Artificial Sequence: Synthetic oligonucleotide"
uccuagcuaucguucuuuuuu

SEQ ID NO: 6493 - RNA, 21 nt, Artificial Sequence
  source: /note="Description of Artificial Sequence: Synthetic oligonucleotide"
aaaagaacgauagcuaggauu

SEQ ID NO: 6494 - RNA, 21 nt, Artificial Sequence
  source: /note="Description of Artificial Sequence: Synthetic oligonucleotide"
auuucuuccaugcggacccuu

SEQ ID NO: 6495 - RNA, 19 nt, Artificial Sequence
  source: /note="Description of Artificial Sequence: Synthetic oligonucleotide"
uuguuuuaugccauuacaa

SEQ ID NO: 6496 - RNA, 19 nt, Artificial Sequence
  source: /note="Description of Artificial Sequence: Synthetic oligonucleotide"
ccauuacaacucuccacaa

SEQ ID NO: 6497 - RNA, 19 nt, Artificial Sequence
  source: /note="Description of Artificial Sequence: Synthetic oligonucleotide"
aacuggauagucagcacca

We claim:

1. A composition comprising a RNAi agent comprising a sense strand and an antisense strand, wherein the antisense strand is 19-40 nucleotides in length and comprises the sequence AAAAGAACGAUAGCUAGGA (SEQ ID NO: 6121) (5'→3'), wherein SEQ ID NO: 6121 is nucleotides 1-19 from the 5' terminal end of the antisense strand, and wherein SEQ ID NO: 6121 comprises at least one modified backbone and/or at least one 2'-modified nucleotide.

2. The composition of claim 1, wherein the composition further comprises a second RNAi agent to Beta-Catenin.

3. The composition of claim 1, wherein the sense strand of the RNAi agent comprises at least one modified backbone and/or at least one 2'-modified nucleotide.

4. The composition of claim 1, wherein the RNAi agent is ligated to one or more agent selected from: diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

5. The composition of claim 1, wherein the RNAi agent comprises a phosphorothioate linkage and/or a 2'-O-methyl modified nucleotide.

6. The composition of claim 4, wherein the RNAi agent is ligated to one or more agents, the agent selected from cholesterol, carbohydrate, synthetic carbohydrate, natural polymer, low- or medium-molecular weight polymer, integrin-targeting molecule, peptide, polyamine, peptide mimic, and/or transferrin.

7. The composition of claim 1, further comprising a pharmaceutically effective excipient.

8. The composition of claim 1, wherein all the pyrimidines are 2' O-methyl-modified nucleotides.

9. The composition of claim 4, wherein all the pyrimidines are 2' O-methyl-modified nucleotides.

* * * * *